US007862826B2

(12) United States Patent
Murphy et al.

(10) Patent No.: US 7,862,826 B2
(45) Date of Patent: Jan. 4, 2011

(54) TROPHIC FACTOR COMBINATIONS FOR NERVOUS SYSTEM TREATMENT

(75) Inventors: Christopher J. Murphy, Madison, WI (US); Jonathan F. McAnulty, Oregon, WI (US); Gordon S. Mitchell, Madison, WI (US); Francis J. Golder, Stoughton, WI (US)

(73) Assignee: Wisconsin Alumni Research Foundation, Madison, WI (US)

(*) Notice: Subject to any disclaimer, the term of this patent is extended or adjusted under 35 U.S.C. 154(b) by 0 days.

(21) Appl. No.: 12/123,366

(22) Filed: May 19, 2008

(65) Prior Publication Data
US 2009/0298741 A1 Dec. 3, 2009

Related U.S. Application Data

(62) Division of application No. 11/214,372, filed on Aug. 29, 2005, now abandoned.

(60) Provisional application No. 60/604,912, filed on Aug. 27, 2004.

(51) Int. Cl.
*A61K 39/00* (2006.01)
*A61K 38/18* (2006.01)
*C07K 14/00* (2006.01)

(52) U.S. Cl. .............. 424/198.1; 514/1.1; 514/7.6; 514/8.6; 514/9.4; 514/17.7; 530/350

(58) Field of Classification Search .............. None
See application file for complete search history.

(56) References Cited

U.S. PATENT DOCUMENTS

| | | | |
|---|---|---|---|
| 4,543,252 A | 9/1985 | Lehrer et al. | |
| 4,659,692 A | 4/1987 | Lehrer et al. | |
| 4,705,777 A | 11/1987 | Lehrer et al. | |
| 5,130,298 A | 7/1992 | Cini et al. | |
| 5,183,805 A | 2/1993 | Lee et al. | |
| 5,210,185 A | 5/1993 | Della Valle et al. | |
| 5,218,093 A | 6/1993 | Guo et al. | |
| 5,410,019 A | 4/1995 | Coy et al. | |
| 5,457,034 A | 10/1995 | Della Valle et al. | |
| 5,470,828 A | 11/1995 | Ballard et al. | |
| 5,639,664 A | 6/1997 | Iwane et al. | |
| 5,650,496 A | 7/1997 | Brierley et al. | |
| 5,792,831 A | 8/1998 | Maloy | |
| 5,821,056 A | 10/1998 | Lee | |
| 5,998,376 A | 12/1999 | Witten et al. | |
| 2002/0090369 A1 | 7/2002 | Murphy et al. | |
| 2003/0083389 A1 | 5/2003 | Kao et al. | |
| 2007/0207209 A1 | 9/2007 | Murphy et al. | |

FOREIGN PATENT DOCUMENTS

WO 0209738 A1 2/2002

OTHER PUBLICATIONS

Sitaram, et al., Biochimica et Biophysica Acta, 1462:29-54, 1999.*
McAnulty et al., Am J Transplantation, 2:712-718, 2002.*
Kulagina et al., Sens Actuators B Chem, 121(1):150-157, 2007.*
Kagawa et al., Seminars in Respiratory Infect., 18(3): 183-195, 2003.*
Houle et al., Experimental Neurology, 182:247-260, 2003.*
A & G Pharmaceutical innovative drug discovery and biotechnology, "PCDGF" (PC cell-derived growth factor), http://www.agrx.net/technologies/pcdgf.html, 3 pgs., printed from website Jan. 29, 2004.
Anderson, M. L. M. and Young, B.D., "Quantitative filter hybridization," Chap. 4 of "Nucleic acid hybridization: a practical approach," IRL Press Ltd, Oxford, England, pp. 73-110 (1985).
Baker-Herman, T. L. et al, "Phrenic long-term facilitation requires spinal serotonin receptor activation and protein synthesis," J. Neuroscience, 22(14):6239-6246 (Jul. 15, 2002).
www.bbcm.units, ANTIMICROBIAL Peptides Laboratory, University of Trieste, Italy, http://www.bbcm.univ.trieste.it/~antimic/Tossi_CV.html, 2 pgs., printed from website May 28, 2008 and Aug. 22, 2008.
Beaucage, S. L. et al, "Dexynucleoside phosphoramidites-a new class of key intermediates for deoxypolynucleotide synthesis," Tetra. Letters, 22(20):1859-1862 (1981).
Biochem, "Growth Factor," http://www.biochem.northwestern.edu/holmgren/Glossary/Definitions/Def-G/growth_fact..., 1 pg., printed from website Jan. 16, 2004.
Bramachary, M. et al, "ANTIMIC: a database of antimicrobial sequences," Nucleic Acids Research, 34:D586-D589, 2004. (http://sdmc.lit.org.sg/Templar/DB/Antimic/).
Braverman, J. M., "Airway clearance needs in spinal cord injury: an overview," 1999-2001 Advanced Respiratory, 6 pgs.
Carey, F. A. et al, "Advanced organic chemistry, Part B: Reactions and synthesis," 5th ed., Springer Science, NY (2007), (book's Table of Contents, 10 pgs.).
Eisenhauer, P. B. et al, "Purification and antimicrobial properties of three defensins from rat neutrophils," Infection and Immunity 57(7):2021-2027 (1989).
Fuller, D.D. et al, "Synaptic pathways to phrenic motoneurons are enhanced by chronic intermittent hypoxia after cervical spinal cord injury," J. Neuroscience, 23(7):2993-3000 (Apr. 1, 2003).
Ganz, T. et al, "Defensins: natural peptide antibiotics of human neutrophils," J. Clin. Invest. 76:1427-1435 (1985).
Garstang, S. V., "Cardiovascular concerns in spinal cord injury," http://www.emedicine.com/pmr/topic20.htm, 13 pgs., printed from website Jan. 16, 2004.

(Continued)

*Primary Examiner*—Daniel E Kolker
*Assistant Examiner*—Stacey MacFarlane
(74) *Attorney, Agent, or Firm*—Whyte Hirschboeck Dudek S.C.

(57) ABSTRACT

The present invention relates to a composition including an effective amount of at least one of an antimicrobial peptide and a substance having an antimicrobial peptide effect and an effective amount of a neurotrophin. The composition can also include an effective amount of at least one of a growth factor and a neuropeptide. The present invention also relates a method of treating an injury to a nervous system of an animal that includes the steps of identifying the injury to the nervous system and applying to the injury an effective amount of at least one of antimicrobial peptide and a substance having an antimicrobial peptide effect. The method can also include applying an effective amount of one or more trophic factors selected from the group consisting of a growth factor, a neurotrophin, and a neuropeptide to the injury.

19 Claims, 5 Drawing Sheets

OTHER PUBLICATIONS

Kamysz, W. et al, "Novel properties of antimicrobial peptides," Acta Biochimica Polonica, 50:461-469, Feb. 2003.

Lehrer, R. I. et al, "Nonoxidative fungicidal mechanisms of mammalian granulocytes: demonstration of components with candidacidal activity in human, rabbit, and guinea pig leukocytes," Infection and Immunity, 11(6):1226-1234 (1975).

Lehrer, R. I. et al, "Direct inactivation of viruses by MCP-1 and MCP-2, natural peptide antibiotics from rabbit leukocytes," J. Virol. 54:467-472 (1985).

Lehrer, R. I. et al, "Fungicidal components of mammalian granulocytes active against *Cryptococcus neoformans*," J. Infect. Disease, 136(1):96-99 (1977).

Merrifield, R. B., "Solid phase peptide synthesis. I. The synthesis of a tetrapeptide," J. Am. Chem. Soc. 85:2149-2156 (1963).

Merrifield, R. B. et al, "Design and synthesis of antimicrobial peptides," Ciba Found Symp. 186:5-26 (1994).

Mitchell, Gordon S. et al, "Physiological and genomic consequences of intermittent hypoxia invited review: intermittent hypoxia and respiratory plasticity," J. Appl Physiol 90:2466-2475 (2001).

Murphy, C. J. et al, "Defensins are mitogenic for epithelial cells and fibroblasts," J. Cell. Physiol. 155:408-413 (1993).

National Institute of Neurological Disorders and Stroke, "Spinal cord injury: hope through research," http://www.ninds.nih.gov/health_and_medical/pubs/sci.htm, 26 pgs, printed from website Jan. 21, 2004.

National Institute of Neurological Disorders and Stroke, "Spinal cord injury: emerging concepts," http://www.ninds.nih.gov/health_and_medical/pubs/sci_report.htm, 40 pgs, printed from website Jan. 21, 2004.

Neuromuscular, "Trophic factors," 16 pgs., http://www.neuro.wustl.edu/neuromuscular/lab/trophic.htm, printed from website Jan. 19, 2004.

Newton, C. R. et al, "PCR", 2nd Ed., Springer-Verlag (New York, 1997), pp. 24-25.

Nih, Growth factor-Glossary Entry, "Genetics Home Reference," http://ghr.nlm.nih.gov/ghr/glossary/growthfactor, 1 pg., printed from website Jan. 16, 2004.

Nscia, "About spinal cord injury," 4 pgs., http://www.spinalcord.org/html/injury.php, printed from website Jan. 15, 2004.

Otsuka, H. et al, "PEGylated nanoparticles for biological and pharmaceutical applications," Advanced Drug Delivery Reviews, 55:403-419 (2003).

PNS (Peripheral Nerve Society), front page of website, http://pns.ucsd.edu/, printed Jan. 21, 2004.

Rein, R. et al, eds., "Computer-assisted modeling of receptor-ligand interactions," Proceedings of 33rd OHOLO Conference held in Eilat, Israel, Apr. 24-28, 1988, Alan R. Liss, Inc., NY (1989). Table of Contents.

Romeo, D., et al, "Structure and bactericidal activity of an antibiotic dodecapeptide purified from bovine neutrophils," J. Bio. Chem, 263(15):9573-9575 (1988).

SCOP (Structural Classification of Proteins), "Protein: placenta growth factor-1, PLGF-1 from human (*Homo sapiens*)," http://scop.berkeley.edu/data/scop.b.h.bi.b.b.d.html, 1 pg., printed from website, Jan. 26, 2004.

Segal et al, "In vitro effect of phagocyte cationic peptides on *Coccidioides immitis*," J. Infectious Disease, 151 (5):890-894 (1985).

Selsted, M. E. et al, "Purification and antibacterial activity of antimicrobial peptides of rabbit granulocytes," Infection and Immunity, 45(1):150-154 (1984).

Selsted, M. E. et al, "Activity of rabbit leukocyte peptides against *Candida albicans*," Infection and Immunity 49 (1):202-206 (1985).

Selsted, M. E. et al, "Purification, primary structure, and antimicrobial activities of a guinea pig neutrophil defensin," Infection and Immunity, 55(9):2281-2286 (1987).

Serrero, G.I, "Autocrine growth factor revisited: PC-cell-derived growth facto (progranulin), a critical player in breast cancer tumorigenesis," Biochem Biophys Res Commun., 308(3):409-413 (Aug. 29, 2003). Abstract.

Shafer, W. M. ed., "Antimicrobial peptide protocols," Humana Press, Totowa, NJ (1997). (book-Table of Contents).

SPINEUNIVERSE.COM, "Spinal cord injury: emerging concepts-current interventions," an NIH Workshop, http://www.spineuniverse.com/displayarticle.php/article330.html, printed from website Jan. 16, 2004.

UNMC (U. of Nebraska Medical Center), "Welcome to the antimicrobial peptide database," http://aps.unmc.edu/AP/main.php, front page, printed Aug. 22, 2008.

Wade, D. et al, "All-D amino acid-containing channel-forming antibiotic peptides," Proc. Natl. Acad. Sci., USA 87 (12):4761-4765 (1990).

Wang, Z. and Wang, G., "APD: the antimicrobial peptide database," Nucleic Acids Res., 1:32 (Database issue: D590-2) (Jan. 2004).

Wilde, C. G. et al, "Purification and characterization of human neutrophil peptide 4, a novel member of the defensin family," J. Biol. Chem. 264(19):11200-11203 (1989).

Zeya, H. I., et al, "Antimicrobial specificity of leukocyte lysosomal cationic proteins," Science 154:1049-1051 (1966). Abstract.

Zeya, H. I., et al, "Arginine-rich proteins of polymorphonuclear leukocyte lysosomes," J. Exp. Med., 127:927-941 (1968).

Zeya, H. I. et al, "Characterization of cationic protein-bearing granules of polymorphonuclear leukocytes," Lab. Invest. 24(3):229-236 (1971).

Ambiru, S. et al. (2004) Improved survival of orthotopic liver allograft in swine by addition of trophic factors to University of Wisconsin solution. Transplantation. 77:302-19.

Delgado, A.V. et al. (2005) Exogenous administration of Substance P enhances wound healing in a novel skin-injury model. Exp Biol Med 230:271-80.

Gibran, N.S. et al. (2002) Diminished neuropeptide levels contribute to the impaired cutaneous healing response associated with diabetes mellitus. J Surg Res 108:122-128.

Golder, F.J. et al. (2003) Respiratory motor recovery after unilateral spinal cord injury: eliminating crossed phrenic activity decreases tidal volume and increases contralateral respiratory motor output, J Neurosci, 23:2494-501.

Golder, F.J. et al. (2005) Spinal synaptic enhancement with acute intermittent hypoxia improves respiratory function after chronic cervical spinal cord injury, J Neurosci, 25: 2925-32.

Goshgarian, HG. (2003) The crossed phrenic phenomenon: a model for plasticity in the respiratory pathways following spinal cord injury. J Appl Physiol. 94:795-810.

Jakeman, LB et al. (1998) Brain-derived neurotrophic factor stimulates hindlimb stepping and sprouting of cholinergic fibers after spinal cord injury. Exp Neurol. Nov. 1998;154(1):170-84.

Joosten, EA et al. (2004) Local acute application of BDNF in the lesioned spinal cord anti-inflammatory and anti-oxidant effects. Neuroreport. 15:1163-6.

Koda, M, et al. (2002) Brain-derived neurotrophic factor suppresses delayed apoptosis of oligodendrocytes after spinal cord injury in rats. J Neurotrauma.19:777-85.

McAnulty, JF et al. (2002) Successful six-day kidney preservation using trophic factor supplemented media and simple cold storage. : Am J Transplant. 2:712-8.

McTigue, DM, et al. (1998) Neurotrophin-3 and brain-derived neurotrophic factor induce oligodendrocyte proliferation and myelination of regenerating axons in the contused adult rat spinal cord. J Neurosci. 18:5354-65.

Nakamura, M. et al. (1997) Combined effects of substance P and insulin-like growth factor-1 on corneal epithelial wound closure of rabbit in vivo. Curr Eye Res.16:275-8.

Namiki, J, et al. (2000) Effect of brain-derived neurotrophic factor, nerve growth factor, and neurotrophin-3 on functional recovery and regeneration after spinal cord injury in adult rats. J Neurotrauma. 17:1219-31.

Namuri, S, et al. (1978) Stimulatory effects of substance P and nerve growth factor (NGF) on neurite outgrowth in embryonic chick dorsal root ganglia. Neuropharmacology 17:73-76.

Nantwi, K.D., et al. (1999) Spontaneous functional recovery in a paralyzed hemidiaphragm following upper cervical spinal cord injury in adult rats, Neurorehabilitation and Neural Repair, 13:225-234.

Nilsson, J et al. (1985) Stimulation of connective tissue cell growth by substance P and substance K. Nature 315:63-63.

Novikov, L et al. (1997) Brain-derived neurotrophic factor promotes axonal regeneration and long-term survival of adult rat spinal motoneurons in vivo. Neuroscience. 79:765-74.

Ozdinler, PH et al. (2006) IGF-I specifically enhances axon outgrowth of corticospinal motor neurons Nat Neurosci. 9:1371-81.

Pearse, DD et al. (2007) Designing cell- and gene-based regeneration strategies to repair the injured spinal cord. J Neurotrauma. 23:438-52.

Salie, R. et al. (2005) IGF-1 and BDNF promote chick bulbospinal neurite outgrowth in vitro. Int J Dev Neurosci. 23:587-98.

Sharma, HS. (2005) Neuroprotective effects of neurotrophins and melanocortins in spinal cord injury: an experimental study in the rat using pharmacological and morphological approaches. Ann N Y Acad Sci. 1053:407-21.

Sharma, HS et al. (1998) Brain derived neurotrophic factor and insulin like growth factor-1 attenuate upregulation of nitric oxide synthase and cell injury following trauma to the spinal cord. An immunohistochemical study in the rat. Amino Acids. 14:121-9.

Sharma, HS et al. (1997) Topical application of insulin like growth factor-1 reduces edema and upregulation of neuronal nitric oxide synthase following trauma to the rat spinal cord. Acta Neurochir Suppl. 70:130-3.

Tanaka, TT et al. (1988) Effects of substance P and substance K on the growth of cultured keratinocytes. J Invest Dermatol 90:399-401.

Turner, DJ et al. (2007) Substance P regulates migration in rat intestinal epithelial cells. Ann Surg. 245:408-14.

Vavreck, R, et al. (2006) BDNF promotes connections of corticospinal neurons onto spared descending interneurons in spinal cord injured rats. Brain. 129:1534-45.

Ziche, M. et al. (1990) Substance P stimulates neovascularization in vivo and proliferation of cultured endothelial cells. Microvasc Res 40:264-278.

* cited by examiner

TROPHIC FACTOR COMBINATIONS FOR NERVOUS SYSTEM TREATMENT

CROSS-REFERENCE TO RELATED APPLICATIONS

This application is a divisional application of patent application Ser. No. 11/214,372, filed Aug. 29, 2005 now abandoned, which claims priority under 35 U.S.C. §119(e) to U.S. Provisional Patent Application No. 60/604,912, filed Aug. 27, 2004, the entirety of which is incorporated by reference herein.

REFERENCE TO GOVERNMENT GRANT

This invention was made with United States government support awarded by the National Institutes of Health, Grant # HL069064. The United States has certain rights in this invention.

FIELD OF THE INVENTION

The invention relates to combinations of neurochemically active agents for treating a nervous system and the methods of treating a nervous system with the combinatorial treatments.

SUBMISSION OF SEQUENCE LISTING

The contents of the electronic submission of text file Sequence Listing is incorporated herein by reference in its entirety.

BACKGROUND OF THE INVENTION

The nervous system is comprised of two divisions: the central nervous system (CNS) and the peripheral nervous system (PNS). The CNS includes the brain and the spinal cord and controls most functions of the body and mind. The remainder of the nervous system is the PNS. Nerves of the PNS connect the CNS to sensory organs (such as the eyes and ears), other organs of the body, muscles, blood vessels, and glands. The peripheral nerves include the cranial nerves, the spinal nerves, and roots.

The CNS controls all voluntary movement, such as movement of the legs during walking, and all involuntary movement, such as beating of the heart. The spinal cord connects the body and the brain by transmitting information to and from the body and the brain.

The nervous system can be injured in numerous ways, and injuries can be traumatic. For instance, sudden physical assault on a portion of the nervous system results in a traumatic injury. In the case of a traumatic brain injury, the injury can be focal, i.e., confined to a specific area of the brain, or diffuse, i.e., involving more than one area of the brain.

Injuries to the nervous system include contusions, which are bruises of the nervous system, and blood clots. Blood clots can form in or around the nervous system. For example, when bleeding occurs between the skull and the brain, the blood forms a clot. This puts pressure on the brain, which can lead to changes in brain function.

Spinal cord injuries (SCI) are a particular type of injury to the nervous system. As of the year 2000, approximately 450,000 people in the United States have sustained SCI, with more than 10,000 new cases reported in the United States every year. Motor vehicle accidents are the leading cause of SCI (44 percent), followed by acts of violence (24 percent), falls (22 percent), sports injuries (8 percent), and other causes (2 percent). Of the 10,000 new cases of SCI in the United States each year, 51.7% have tetraplegia, i.e., injuries to one of the eight cervical segments of the spinal cord, and 56.7% have paraplegia, i.e., lesions in the thoracic, lumbar, or sacral regions of the spinal cord. Since 1990, the most frequent neurologic category is incomplete tetraplegia (29.5%), followed by complete paraplegia (27.9%), incomplete paraplegia (21.3%), and complete tetraplegia (18.5%).

With spinal cord injuries in the neck, significant impairment of breathing may result. The most frequent site of spinal injury is the neck or cervical region and, of these, the major cause of death arises from respiratory complications. For patients that survive a major spinal cord injury in the neck, they may spend the rest of their lives depending on an artificial ventilator or phrenic nerve pacemaker to sustain their lives. For others with less severe respiratory impairment, they may be able to breathe normally, but are unable to sigh or breathe deeply and maintain the integrity of the lung. As a consequence, regions of the lung will collapse in these patients, causing pneumonia and allowing other respiratory infections to become established. Clearly, restoration of normal breathing ability, including deep breaths and sighs, is a major goal in the treatment of spinal cord injury patients.

Injury to the spinal cord and other parts of the nervous system may be particularly devastating to life and the quality of life. In addition, injury to the nervous system can engender serious economic losses to the individual and to society. Currently, there are few effective treatment options available for patients with spinal cord injuries, although there are a few promising indications that physical therapy or chronic intermittent hypoxia (CIH), may have beneficial effects. Exposure to intermittent hypoxic episodes has been shown to initiate spinal protein synthesis. However, studies have also shown that chronic intermittent hypoxia has other drawbacks as a treatment for spinal cord injuries. For example, certain CIH treatment methods can cause systemic hypertension, altered sympathetic chemoreflexes, and hippocampal cell death by the process of apoptosis.

Physical training and preconditioning have been used to treat SCI. Almost all patients with spinal cord injuries can now achieve a partial return of function with proper physical therapy that maintains flexibility and function of the muscles and joints, and strengthens the neural pathways that underlie movement. Physical therapy can also help reduce the risk of blood clots and boost the patient's morale. Physical training currently being investigated includes body weight-supported treadmill training, in which patients with partial spinal cord injury "walk" on a treadmill while they are partially supported through the use of a specially designed harness attached to an overhead lift. Unfortunately, this type of therapy is very expensive, and efficacy is far from complete.

SUMMARY OF THE INVENTION

The invention, which is defined by the claims set out at the end of this disclosure, is intended to solve at least some of the problems noted above. A composition is provided that includes an effective amount of at least one of an antimicrobial peptide and a substance having an antimicrobial peptide effect. The composition also includes an effective amount of a neurotrophin.

In another embodiment, the composition also includes an effective amount of at least one of a growth factor and a neuropeptide.

Also provided is a method of treating an injury to a nervous system of an animal. In one embodiment, the method includes the steps of identifying the injury to the nervous system and applying to the injury an effective amount of at least one of antimicrobial peptide and a substance having an antimicrobial peptide effect.

In another embodiment, an injury to the nervous system is identified. An effective amount of at least one of an antimicrobial peptide and a substance having an antimicrobial peptide effect is combined with an effective amount of one or more trophic factors selected from the group consisting of a growth factor, a neurotrophin, and a neuropeptide. The combination is applied to the injury.

A kit is also provided. In an embodiment, the kit includes at least one of an antimicrobial peptide and a substance having an antimicrobial peptide effect. The kit also includes a neurotrophin. In another embodiment, the kit also includes a viscous substance. In some embodiments, the kit also includes at least one of a growth factor and a neuropeptide.

BRIEF DESCRIPTION OF THE DRAWINGS

Preferred exemplary embodiments of the invention are illustrated in the accompanying drawings in which:

FIG. 5 also shows change in phrenic amplitude at 2 weeks post-injury (Y-axis) in the rats (X-axis) for spinal injury alone (SCI) and for spinal injury and a trophic factor combination made in accordance with the invention (SCI+NTs).

Figure 1:
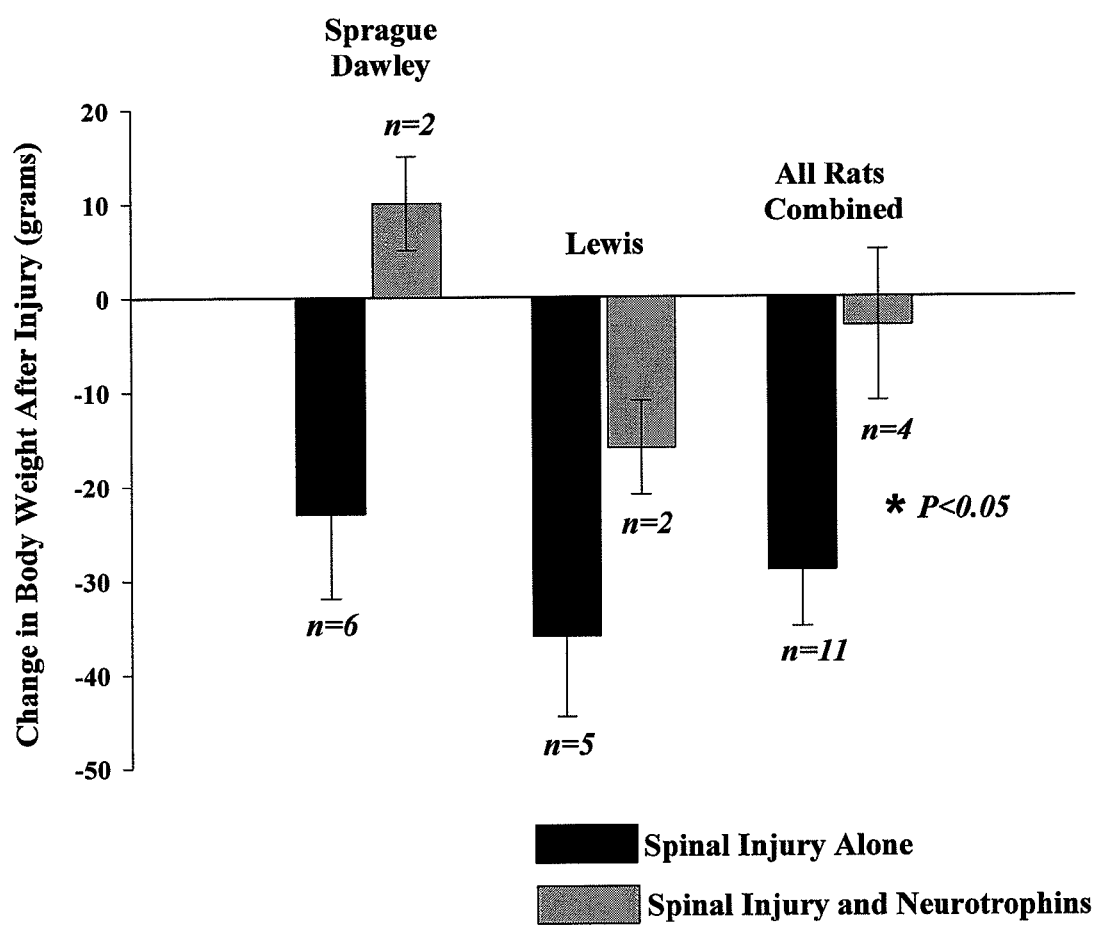
FIG. 1 is a graph showing change in body weight at 2 weeks after spinal cord injury (Y-axis) in two strains of rats, Sprague Dawley and Lewis (X-axis). For each strain of rats, the body weight is shown for spinal injury alone (black bar) and for spinal injury and a trophic factor combination made in accordance with the invention (grey bar). In addition, corresponding data are shown for all rats combined.

Before explaining embodiments of the invention in detail, it is to be understood that the invention is not limited in its application to the details of construction and the arrangement of the components set forth in the following description or illustrated in the drawings. The invention is capable of other embodiments or being practiced or carried out in various ways. Also, it is to be understood that the phraseology and terminology employed herein is for the purpose of description and should not be regarded as limiting.

DETAILED DESCRIPTION

Definitions

To facilitate understanding of the invention, a number of terms are defined below.

As used herein, the term "antimicrobial polypeptide" refers to polypeptides that inhibit the growth of microbes (e.g., bacteria). Examples of antimicrobial polypeptides include, but are not limited to, the polypeptides described in Tables 1 and 2 below. Antimicrobial polypeptides include peptides synthesized from both L-amino and D-amino acids.

As used herein, the term "pore forming agent" refers to any agent (e.g., peptide or other organic compound) that forms pores in a biological membrane. When the pore forming agent is a peptide, the peptide can be synthesized from both L-amino and D-amino acids.

As used herein, the term "growth factor" refers to any compound that is involved in cell differentiation and growth. Growth factors can be proteins (e.g., IGF-1 (insulin-like growth factor 1), IGF-2 (insulin-like growth factor 2), NGF-β (nerve growth factor-β), EGF (epidermal growth factor), CSGF (colony-stimulating growth factor), FGF (fibroblast growth factor), PDGF (platelet-derived growth factor), VEGF (vascular endothelial growth factor), TGF-β (transforming growth factor β, and bone morphogenetic proteins)), either purified from natural sources or genetically engineered, as well as fragments, mimetics, and derivatives or modifications thereof. Further examples of growth factors are provided in U.S. Pat. Nos. 5,183,805; 5,218,093; 5,130,298; 5,639,664; 5,457,034; 5,210,185; 5,470,828; 5,650,496; 5,998,376; and 5,410,019; all of which are incorporated herein by reference.

The term "trophic factor" as used herein refers to a substance that stimulates growth and development or stimulates increased activity.

The term "hyaluronic acid" includes hyaluronic acid and its derivatives, for instance, esters, salts such as the sodium, potassium, magnesium, calcium, alkaline, alkaline earth metals, and the like, and derivatives such as sulphated or polysulphated hyaluronates, or hyaluronates that have been otherwise modified in a manner way such that the function of hyaluronic acid is retained.

The term "recombinant protein" or "recombinant polypeptide" as used herein refers to a protein molecule expressed from a recombinant DNA molecule. In contrast, the term "native protein" or "native polypeptide" is used herein to indicate a protein isolated from a naturally occurring (i.e., a nonrecombinant) source. Molecular biological techniques may be used to produce a recombinant form of a protein or polypeptide with similar or identical properties as compared to the native form of the protein.

Where an amino acid sequence is recited herein to refer to an amino acid sequence of a naturally occurring protein molecule, amino acid sequence and like terms, such as polypeptide or protein are not meant to limit the amino acid sequence to the complete, native amino acid sequence associated with the recited protein molecule.

As used herein in reference to an amino acid sequence or a protein, the term "portion" (as in "a portion of an amino acid sequence") refers to fragments of that protein. The fragments may range in size from four amino acid residues to the entire amino acid sequence minus one amino acid (e.g., 5, 6, 7, 8, . . . x−1).

As used herein, the term "variant," when used in reference to a protein, refers to a protein encoded by partially homologous nucleic acids so that the amino acid sequence of the protein varies. As used herein, the term "variant" encompasses proteins encoded by homologous genes having both conservative and nonconservative amino acid substitutions that do not result in a change in protein function, as well as proteins encoded by homologous genes having amino acid substitutions that cause decreased protein function or increased protein function.

As used herein, the term "fusion protein" refers to a chimeric protein containing the protein of interest (e.g., defensins and fragments thereof) joined to a heterologous protein fragment (e.g., the fusion partner which consists of a non-defensin protein). The fusion partner may enhance the solubility of a defensin as expressed in a host cell, may provide an affinity tag to allow purification of the recombinant fusion protein from the host cell or culture supernatant, or both. If desired, the fusion protein may be removed from the protein of interest (e.g., defensin or fragments thereof) by a variety of enzymatic or chemical processes known to the art.

As used herein, the term "purified" refers to molecules, either nucleic or amino acid sequences, that are removed from their natural environment, isolated, or separated. The percent of a purified component is thereby increased in the sample. For example, an isolated defensin is therefore a purified defensin. Substantially purified molecules are at least 60% free, preferably at least 75% free, and more preferably at least 90% free from other components with which they are naturally associated.

The term "gene" as used herein, refers to a DNA sequence that comprises control and coding sequences necessary for the production of a polypeptide or protein precursor. The polypeptide can be encoded by a full length coding sequence or by any portion of the coding sequence, as long as the desired protein activity is retained.

The term "homology" refers to a degree of complementarity. There may be partial homology or complete homology (i.e., identity). A "partially complementary sequence" is one that at least partially inhibits a completely complementary sequence from hybridizing to a target nucleic acid. This situation is referred to using the functional term "substantially homologous." The inhibition of hybridization of the completely complementary sequence to the target sequence may be examined using a hybridization assay (e.g., Southern or Northern blot, solution hybridization, and the like) under conditions of low stringency. A substantially homologous sequence or probe will compete for and inhibit the binding (i.e., the hybridization) of a completely homologous sequence or probe to a target under conditions of low stringency. This is not to say that conditions of low stringency are such that non-specific binding is permitted; low stringency conditions require that the binding of two sequences to one another be a specific (i.e., selective) interaction. The absence of non-specific binding may be tested by the use of a second target that lacks even a partial degree of complementarity (e.g., less than about 30% identity). In this case, in the absence of non-specific binding, the probe will not hybridize to the second non-complementary target.

When used in reference to a double-stranded nucleic acid sequence such as a cDNA or a genomic clone, the term "substantially homologous" refers to any probe which can hybridize to either or both strands of the double-stranded nucleic acid sequence under conditions of low stringency as described herein.

As used herein, the term "hybridization" is used in reference to the pairing of complementary nucleic acid strands. Hybridization and the strength of hybridization (i.e., the strength of the association between nucleic acid strands) is impacted by many factors well known in the art including the degree of complementarity between the nucleic acids, stringency of the conditions involved affected by such conditions as the concentration of salts, the $T_m$ (melting temperature) of the formed hybrid, the presence of other components (e.g., the presence or absence of polyethylene glycol), the molarity of the hybridizing strands, and the G:C content of the nucleic acid strands.

As used herein, the term "stringency" is used in reference to the conditions of temperature, ionic strength, and the presence of other compounds, under which nucleic acid hybridizations are conducted. With high stringency conditions, nucleic acid base pairing will occur only between nucleic acid fragments that have a high frequency of complementary base sequences. Thus, conditions of medium or low stringency are often required when it is desired that nucleic acids that are not completely complementary to one another be hybridized or annealed together. It is well known in the art that numerous equivalent conditions can be employed to comprise medium or low stringency conditions. The choice of hybridization conditions is generally evident to one skilled in the art and is normally guided by the purpose of the hybridization, the type of hybridization (DNA-DNA or DNA-RNA), and the level of desired relatedness between the sequences (e.g., Sambrook et al., 1989, *Nucleic Acid Hybridization, A Practical Approach*, IRL Press, Washington D.C., 1985, for a general discussion of the state of the art).

The stability of nucleic acid duplexes is known to decrease with an increased number of mismatched bases, and further to be decreased to a greater or lesser degree depending on the relative positions of mismatches in the hybrid duplexes. Thus, the stringency of hybridization can be used to maximize or minimize stability of such duplexes. Hybridization stringency can be altered, for example, by adjusting the temperature of hybridization; adjusting the percentage of helix destabilizing agents, such as formamide, in the hybridization mix; and adjusting the temperature and/or salt concentration of the wash solutions. For filter hybridizations, the final stringency of hybridizations can be determined by the salt concentration and/or temperature used for the post-hybridization washes.

"High stringency conditions" when used in reference to nucleic acid hybridization comprise conditions equivalent to binding or hybridization at 42° C. in a solution consisting of 5×SSPE (43.8 g/l NaCl, 6.9 g/l $NaH_2PO_4.H_2O$ and 1.85 g/l EDTA, pH adjusted to 7.4 with NaOH), 0.5% SDS, 5×Denhardt's reagent and 100 µg/ml denatured salmon sperm DNA followed by washing in a solution comprising 0.1×SSPE, 1.0% SDS at 42° C. when a probe of about 500 nucleotides in length is employed.

"Medium stringency conditions" when used in reference to nucleic acid hybridization comprise conditions equivalent to binding or hybridization at 42° C. in a solution consisting of 5×SSPE (43.8 g/l NaCl, 6.9 g/l $NaH_2PO_4.H_2O$ and 1.85 g/l EDTA, pH adjusted to 7.4 with NaOH), 0.5% SDS, 5×Denhardt's reagent and 100 µg/ml denatured salmon sperm DNA followed by washing in a solution comprising 1.0×SSPE, 1.0% SDS at 42° C. when a probe of about 500 nucleotides in length is employed.

"Low stringency conditions" comprise conditions equivalent to binding or hybridization at 42° C. in a solution consisting of 5×SSPE (43.8 g/l NaCl, 6.9 g/l $NaH_2PO_4.H_2O$ and 1.85 g/l EDTA, pH adjusted to 7.4 with NaOH), 0.1% SDS, 5×Denhardt's reagent [50×Denhardt's contains per 500 ml: 5 g Ficoll (Type 400, Pharamcia), 5 g BSA (Fraction V; Sigma)] and 100 µg/ml denatured salmon sperm DNA followed by washing in a solution comprising 5×SSPE, 0.1% SDS at 42° C. when a probe of about 500 nucleotides in length is employed.

As used herein, the term "$T_m$" is used in reference to the melting temperature, which is the temperature at which 50% of a population of double-stranded nucleic acid molecules becomes dissociated into single strands. The equation for calculating the Tm of nucleic acids is well known in the art. The $T_m$ of a hybrid nucleic acid can be estimated using a formula adopted from hybridization assays in 1 M salt, and commonly used for calculating $T_m$ for PCR primers: [(number of A+T)×2° C.+(number of G+C)×4° C.]. (C. R. Newton et al., *PCR*, 2nd Ed., Springer-Verlag (New York, 1997), p. 24). This formula was found to be inaccurate for primers longer than 20 nucleotides. (Id.) Another simple estimate of the $T_m$ value can be calculated by the equation: $T_m$=81.5+ 0.41(% G+C), when a nucleic acid is in aqueous solution at 1 M NaCl. (e.g., Anderson and Young, Quantitative Filter Hybridization, in *Nucleic Acid Hybridization* (1985). Other more sophisticated computations exist in the art which take structural as well as sequence characteristics into account for the calculation of $T_m$. A calculated $T_m$ is merely an estimate; the optimum temperature is commonly determined empirically.

As used herein, the term "vector" is used in reference to nucleic acid molecules that transfer DNA segment(s) from one cell to another and capable of replication in a cell. Vectors may include plasmids, bacteriophages, viruses, cosmids, and the like.

The terms "recombinant vector" and "expression vector" as used herein refer to DNA or RNA sequences containing a desired coding sequence and appropriate DNA or RNA sequences necessary for the expression of the operably linked coding sequence in a particular host organism. Prokaryotic expression vectors include a promoter, a ribosome binding site, an origin of replication for autonomous replication in host cells and can also include other sequences, e.g., an optional operator sequence. A "promoter" is defined as a DNA sequence that directs RNA polymerase to bind to DNA and to initiate RNA synthesis. Eukaryotic expression vectors include a promoter, polyadenlyation signal and optionally an enhancer sequence.

As used herein the term "coding region" when used in reference to structural gene refers to the nucleotide sequences which encode the amino acids found in the nascent polypeptide as a result of translation of a mRNA molecule. Typically, the coding region is bounded on the 5' side by the nucleotide triplet ATG, which encodes the initiator methionine, and on the 3' side by a stop codon (e.g., TAA, TAG, TGA). In some cases, the coding region is also known to initiate by a nucleotide triplet TTG.

The terms "buffer" or "buffering agents" refer to materials that when added to a solution, cause the solution to resist changes in pH.

The term "monovalent salt" refers to any salt in which the metal (e.g., Na, K, or Li) has a net 1+ charge in solution (i.e., one more proton than electron).

The term "divalent salt" refers to any salt in which a metal (e.g., Mg, Ca, or Sr) has a net 2+ charge in solution.

The term "solution" refers to an aqueous mixture.

The term "buffering solution" refers to a solution containing a buffering reagent.

The present invention relates to neurochemically active agents and combinations thereof. Neurochemically active agents include one or more antimicrobial peptide and/or a substance having an antimicrobial peptide effect. Antimicrobial peptides themselves are known to have trophic effects. As such, an antimicrobial peptide and/or a substance having an antimicrobial peptide effect can be used by itself in the methods of the invention. Neurochemically active agents also include one or more growth factor, neurotrophin, and neuropeptide. Combinations of neurochemically active agents are referred to herein as "trophic factor combinations."

According to the invention, neurochemically active agents can be used alone or in combination to treat injuries to the nervous system, i.e., the central nervous system and the peripheral nervous system. The one or more neurochemically active agents can be used to treat nervous system injuries, including trauma induced injuries, degenerative induced injuries, age induced injuries, and infection induced injuries. Injuries that can be treated include, but are not limited to, spinal cord injury, including severed spinal cords; peripheral nerve damage, brain injuries, e.g., blood clots, tumors, strokes, and ischemis and perfusion; and Parkinson's disease, Alzheimer disease, muscular dystrophy, amyotrophic lateral sclerosis, multiple sclerosis, Pick's disease, prion diseases, Huntington disease, and related disorders.

When applied to a the nervous system, trophic factor combinations of the invention result in at least one of the following: lower loss in body weight after the injury when compared to controls not receiving the trophic factor combinations, strengthened motor recovery in injured animals treated with the trophic factor combination when compared to animals not treated with the trophic factor combination, larger evoked potentials in nerves when compared to controls not receiving the trophic factor combination, and a lower current required to evoke a response (threshold current) when compared to controls not receiving the trophic factor combination.

It is contemplated that the trophic factor combinations of the present invention used to treat injuries of the nervous system result in reduced inflammation, growth of new cells, increased plasticity, among other beneficial effects.

I. Trophic Factor Combinations

The present invention contemplates the use of trophic factor combinations and their individual components for treatment of injuries to the nervous system. Trophic factor combinations according to the invention can include one or more of the following elements: antimicrobial polypeptides (e.g., defensins), a substance having an effect of an antimicrobial peptide, a growth factor, a neurotrophin, and a neuropeptide. Additional components can also be included and are discussed below.

A. Antimicrobial Peptides

In some embodiments, one or more antimicrobial polypeptides and/or one or more substances having an antimicrobial peptide effect are used as a trophic factor to treat an injury to a nervous system. For additional information on antimicrobial peptides, see, for example, *Antimicrobial Peptide Protocols*, ed. W. M. Shafer, Humana Press, Totowa, N.J., 1997; and databases including http://aps.unmc.edu/AP/main.php (discussed in Wang Z, Wang G., APD: the Antimicrobial Peptide Database, Nucleic Acids Res. 2004 Jan. 1; 32(Database issue):D590-2), http://sdmc.lit.org.sg/Templar/DB/Antimic/, and http://www.bbcm.units.it/~zelezetsk/hdpdb.html (database of defense peptides) and Table 1 below.

In some embodiments, the antimicrobial peptide is a compound or peptide selected from the following: bovine defensin peptide (BNP-1, Romeo et al., J. Biol. Chem. 263

(15):9573-9575 [1988]), magainin (e.g., magainin I, magainin II, xenopsin, xenopsin precursor fragment, caerulein precursor fragment), magainin I and II analogs (PGLa, magainin A, magainin G, pexiganin, Z-12, pexigainin acetate, D35, MSI-78A, MG0 [K10E, K11E, F12W-magainin 2], MG2+ [KIOE, F12W-magainin-2], MG4+ [F12W-magainin 2], MG6+ [f12W, E19Q-magainin 2 amide], MSI-238, reversed magainin II analogs [e.g., 53D, 87-ISM, and A87-ISM], Ala-magainin II amide, magainin II amide), cecropin P1, cecropin A, cecropin B, indolicidin, nisin, ranalexin, lactoferricin B, poly-L-lysine, cecropin A (1-8)-magainin II (1-12), cecropin A (1-8)-melittin (1-12), CA(1-13)-MA(1-13), CA(1-13)-ME (1-13), gramicidin, gramicidin A, gramicidin D, gramicidin S, alamethicin, protegrin, histatin, dermaseptin, lentivirus amphipathic peptide or analog, parasin I, lycotoxin I or II, globomycin, gramicidin S, surfactin, ralinomycin, valinomycin, polymyxin B, PM2 [(+/−) 1-(4-aminobutyl)-6-benzylindane], PM2c [(+/−)-6-benzyl-1-(3-carboxypropyl)indane], PM3 [(+/−) 1-benzyl-6-(4-aminobutyl)indane], tachyplesin, buforin I or II, misgurin, melittin, PR-39, PR-26, 9-phenyl-nonylamine, (KLAKKLA)n, (KLAKLAK)n, where n=1, 2, or 3, (KALKALK)$_3$, KLGKKLG)n, and KAAKKAA)n, wherein N=1, 2, or 3, paradaxin, Bac 5, Bac 7, ceratoxin, mdelin 1 and 5, bombin-like peptides, PGQ, cathelicidin, HD-5, Oabac5alpha, ChBac5, SMAP-29, Bac7.5, lactoferrin, granulysin, thionin, hevein and knottin-like peptides, MPG1, 1bAMP, snakin, lipid transfer proteins, and plant defensins. Exemplary sequences for the above listed compounds are provided in Table 1. In some embodiments, the antimicrobial peptides or substances having an antimicrobial peptide effect (where they are peptides) are synthesized from L-amino acids, while in other embodiments, the peptides are synthesized from or comprise D-amino acids.

The compounds listed above can be isolated and purified from natural sources as appropriate. The compounds can also be produced recombinantly or synthetically, as described below.

In preferred embodiments, the trophic factor combinations of the present invention comprise one or more antimicrobial polypeptides and/or one or more substance having an antimicrobial peptide effect at a concentration of about 0.01 to about 1000 mg/L. In preferred embodiments, the trophic factor combinations comprise a solution comprising one or more antimicrobial polypeptides at a concentration of about 0.1 to about 5 mg/L.

In some embodiments of the present invention, the antimicrobial polypeptide is a defensin. In preferred embodiments, the trophic factor combinations of the present invention comprise one or more defensins. In further preferred embodiments, the trophic factor combination comprises a solution comprising purified defensins at a concentration of about 0.01 to 1000 mg/L. In particularly preferred embodiments, the trophic factor combinations comprise a solution comprising defensins at a concentration of about 0.1 to 5 mg/L. In still further preferred embodiments, the antimicrobial polypeptide is BNP1 (also known as bactanecin and bovine dodecapeptide). In certain embodiments, the defensin comprises the following consensus sequence: $X_1CN_1CRN_2CN_3ERN_4CN_5GN_6CCX_2$, wherein N and X represent conservatively or nonconservatively substituted amino acids and $N_1=1$, $N_2=3$ or 4, $N_3=3$ or 4, $N_4=1$, 2, or 3, $N_6=5-9$, $X_1$ and $X_2$ may be present, absent, or equal from 1-2.

The present invention is not limited to any particular defensin. Indeed, trophic factor combinations comprising a variety of defensins are contemplated. Representative defensins are provided in Tables 1 and 2 below. In general, defensins are a family of highly cross-linked, structurally homologous antimicrobial peptides that can be found in the azurophil granules of polymorphonuclear leukocytes (PMNs) with homologous peptides being present in macrophages (e.g., Selsted et al., Infect. Immun. 45:150-154 [1984]). Originally described as "Lysosomal Cationic Peptides" in rabbit and guinea pig PMN (Zeya et al., Science 154:1049-1051 [1966]; Zeya et al., J. Exp. Med. 127:927-941 [1968]; Zeya et al., Lab. Invest. 24:229-236 [1971]; Selsted et al., [1984], supra.), this mixture was found to account for most of the microbicidal activity of the crude rabbit PMN extract against various microorganisms (Zeya et al., [1966], supra; Lehrer et al., J. Infect. Dis. 136:96-99 [1977]; Lehrer et al., Infect. Immun. 11:1226-1234 [1975]). Six rabbit neutrophil defensins have been individually purified and are designated NP-1, NP-2, NP-3A, NP-3B, NP-4, and NP-5. Their amino acid sequences were determined, and their broad spectra of activity were demonstrated against a number of bacteria (Selsted et al., Infect. Immun. 45:150-154 [1984]), viruses (Lehrer et al., J. Virol. 54:467 [1985]), and fungi (Selsted et al., Infect. Immun. 49:202-206 [1985]; Segal et al., 151:890-894 [1985]). Defensins have also been shown to possess mitogenic activity (e.g., Murphy et al., J. Cell. Physiol. 155: 408-13 [1993]).

Four peptides of the defensin family have been isolated from human PMN's and are designated HNP-1, HNP-2, HNP-3, and LNP-4 (Ganz et al., J. Clin. Invest. 76:1427-1435 [1985]; Wilde et al., J. Biol. Chem. 264:11200-11203 [1989]). The amino acid sequences of HNP-1, HNP-2, and HNP-3 differ from each other only in their amino terminal residues, while each of the human defensins are identical to the six rabbit peptides in 10 or 11 of their 29 to 30 residues. These are the same 10 or 11 residues that are shared by all six rabbit peptides. Human defensin peptides have been shown to share with the rabbit defensins a broad spectrum of antimicrobial activity against bacteria, fungi, and enveloped viruses (Ganz et al., [1985], supra).

Three defensins designated RatNP-1, RatNP-2, and RatNP-4, have been isolated from rat (Eisenhauer et al., Infection and Immunity 57:2021-2027 [1989]). A guinea pig defensin (GPNP) has also been isolated, purified, sequenced and its broad spectrum antimicrobial properties verified (Selsted et al., Infect. Immun. 55:2281-2286 [1987]). Eight of its 31 residues were among those invariant in six rabbit and three human defensin peptides. The sequence of GPNP also included three nonconservative substitutions in positions otherwise invariant in the human and rabbit peptides. Of the defensins tested in a quantitative assay HNP-1, RatNP-1, and rabbit NP-1 possess the most potent antimicrobial properties, while NP-5 possesses the least amount of antimicrobial activity when tested against a panel of organisms in stationary growth phase (Selsted et al., Infect. Immun. 45:150-154 [1984]; Ganz et al., J. Clin. Invest. 76:1427-1435 [1985]). Defensin peptides are further described in U.S. Pat. Nos. 4,543,252; 4,659,692; and 4,705,777 (each of which is incorporated herein by reference).

Defensin peptides suitable for use alone in the methods and/or in trophic factor combinations of the present invention include natural defensin peptides isolated from known cellular sources, synthetic peptides produced by solid phase or recombinant DNA techniques, and defensin analogs which may be smaller peptides or other molecules having similar binding and biological activity as the natural defensin peptides (e.g., peptide mimetics). Methods for the purification of defensin peptides are described in U.S. Pat. Nos. 4,543,252; 4,659,692; and 4,705,777, the disclosures of which are incorporated herein by reference.

In preferred embodiments, suitable synthetic peptides will comprise all or part of the amino acid sequence of a known peptide, more preferably incorporating at least some of the conserved regions identified in Table 2. In particularly preferred embodiments, the synthetic peptides incorporate at least one of the conserved regions, more typically incorporating two of the conserved regions, preferably conserving at least three of the conserved regions, and more preferably conserving four or more of the conserved regions. In preferred embodiments, the synthetic peptides comprise fifty amino acids or fewer, although there may be advantages in increasing the size of the peptide above that of the natural peptides in certain instances. In certain embodiments, the peptides have a length in the range from about 10 to 50 amino acids, preferably being in the range from about 10 to 40 amino acids, and most preferably being in the range from about 30 to 35 amino acids which corresponds generally to the length of the natural defensin peptides.

In some cases, it may be desirable to incorporate one or more non-natural amino acids in the synthetic defensin peptides of the present invention. In preferred embodiments, non-natural amino acids comprise at least an N-terminus and a C-terminus of the peptide and have side chains that are either identical to or chemically modified or substituted from a natural amino acid counterpart. An example of a non-natural amino acid is an optical isomer of a naturally-occurring L-amino acid, such as a peptide containing all D-amino acids. Examples of the synthesis of peptides containing all D-amino acids include Merrifield et al., Ciba Found Symp. 186:5-26 (1994); Wade et al., Proc. Natl. Acad. Sci. USA 87(12):4761-5 (1990); and U.S. Pat. No. 5,792,831, which is herein incorporated by reference. Examples of chemical modifications or substitutions include hydroxylation or fluorination of C—H bonds within natural amino acids. Such techniques are used in the manufacture of drug analogs of biological compounds and are known to one of ordinary skill in the art.

Synthetic peptides having biological and binding activity the same or similar to that of natural defensin peptides can be produced by either of two exemplary approaches. First, the polypeptides can be produced by the well-known Merrifield solid-phase chemical synthesis method wherein amino acids are sequentially added to a growing chain (Merrifield, J. Am. Chem. Soc. 85:2149-2156 [1963]). Automatic peptide synthesis equipment is available from several commercial suppliers, including PE Biosystems, Inc., Foster City, Calif.; Beckman Instruments, Inc., Waldwick, N.J.; and Biosearch, Inc., San Raphael, Calif. Using such automatic synthesizers according to manufacturer's instructions, peptides can be produced in gram quantities for use in the present invention.

Second, the synthetic defensin peptides of the present invention can be synthesized by recombinant techniques involving the expression in cultured cells of recombinant DNA molecules encoding a gene for a desired portion of a natural or analog defensin molecule. The gene encoding the defensin peptide can itself be natural or synthetic. Conveniently, polynucleotides can be synthesized by well-known techniques based on the desired amino acid sequence. For example, short single-stranded DNA fragments can be prepared by the phosphoramidite method (Beaucage et al., Tetra. Lett. 22:1859-1862 [1981]). A double-stranded fragment can then be obtained either by synthesizing the complementary strand and annealing the strands together under appropriate conditions, or by adding the complementary strand using DNA polymerase under appropriate conditions, or by adding the complementary strand using DNA polymerase with an appropriate primer sequence. The natural or synthetic DNA fragments coding for the desired defensin peptide can then be incorporated in a suitable DNA construct capable of introduction to and expression in an in vitro cell culture. The DNA fragments can be portions or variants of wild-type nucleic acids encoding defensins. Suitable variants include those both with conservative and nonconservative amino acid substitutions.

The methods, compositions, and trophic factor combinations of the present invention can also employ synthetic non-peptide compositions that have biological activity functionally comparable to that of known defensin peptides. By functionally comparable, it is meant that the shape, size, flexibility, and electronic configuration of the non-peptide molecule is such that the biological activity of the molecule is similar to defensin peptides. In particular, the non-peptide molecules should display comparable mitogenic activity and/or antimicrobial activity or pore forming ability, preferably possessing both activities. Such non-peptide molecules will typically be small molecules having a molecular weight in the range from about 100 to about 1000 daltons. The use of such small molecules is frequently advantageous in the preparation of trophic factor combinations. Candidate mimetics can be screened in large numbers to identify those having the desired activity.

The identification of such nonpeptide analog molecules can be performed using techniques known in the art of drug design. Such techniques include, but are not limited to, self-consistent field (SCF) analysis, configuration interaction (CI) analysis, and normal mode dynamics computer analysis, all of which are well described in the scientific literature (e.g., Rein et al., Computer-Assisted Modeling of Receptor-Ligand Interactions, Alan Liss, N.Y., [1989]). Preparation of the identified compounds will depend on the desired characteristics of the compounds and will involve standard chemical synthetic techniques (e.g., Cary et al., Advanced Organic Chemistry, part B, Plenum Press, New York [1983]).

In some embodiments of the present invention, one or more substances having an effect that an antimicrobial peptide has can be used. Effects that antimicrobial peptides have include, but are not limited to, the following: form pores on the cell membrane; enter cells without membrane lysis and, once in the cytoplasm, bind to, and inhibit the activity of specific molecular targets essential to bacterial growth, thereby causing cell death; induce expression of syndecan, an integral membrane proteoglycan associated largely with epithelial cells, in mesenchymal cells and inhibit the NADPH oxidase activity of neutrophils, suggesting a role of this peptide in wound repair and inflammation; exert a protective effect in various animal models of ischemia-reperfusion injury, preventing the post-ischemic oxidant production; induce angiogenesis both in vitro and in vivo; inhibit membrane protein synthesis; inhibit DNA synthesis; antitumor effect; stimulate cell proliferation; interfere with signal pathways; chemoattractant for immune cells; stimulate cytokine expression; stimulate adhesion molecule expression; angiogenesis; and chloride secretion.

TABLE 1

Human Antimicrobial Peptides

| SEQ ID NO: | Protein Name | Organism Name | Length | Sequence |
|---|---|---|---|---|
| 1 | Antibacterial peptide LL-37 precursor | Homo sapiens | 170 | MKTQRDGHSLGRWSLVLLLLGLVMPLAIIAQVLSYK EAVLRAIDGINQRSSDANLYRLLDLDPRPTMDGDPD TPKPVSFTVKETVCPRTTQQSPEDCDFKKDGLVKR CMGTVNLNQARGSFDISCDKDNKRFALLGDFFRKS KEKIGKEFKRIVQRIKDFLRNLVPRTES |
| 2 | Antibacterial protein FALL-39 precursor | Homo sapiens | 170 | MKTQRDGHSLGRWSLVLLLLGLVMPLAIIAQVLSYK EAVLRAIDGINQRSSDANLYRLLDLDPRPTMDGDPD TPKPVSFTVKETVCPRTTQQSPEDCDFKKDGLVKR CMGTVTLNQARGSFDISCDKDNKRFALLGDFFRKS KEKIGKEFKRIVQRIKDFLRNLVPRTES |
| 3 | Antimicrobial peptide RYA3 | Homo sapiens | 476 | MQPVMLALWSLLLLWGLATPCQELLETVGTLARIDK DELGKAIQNSLVGEPILQNVLGSVTAVNRGLLGSGG LLGGGGLLGHGGVFGVVEELSGLKIEELTLPKVLLKL LPGFGVQLSLHTKVGMHCSGPLGGLLQLAAEVNVT SRVALAVSSRGTPILILKRCSTLLGHISLFSGLLPTPL FGVVEQMLFKVLPGLLCPVVDSVLGVVNELLGAVLG LVSLGALGSVEFSLATLPLISNQYIELDINPIVKSVAG DIIDFPKSRAPAKVPPKKDHTSQVMVPLYLFNTTFGL LQTNGALDMDITPELVPSDVPLTTTDLAALLPEALGK LPLHQQLLLFLRVREAPTVTLHNKKALVSLPANIHVL FYVPKGTPESLFELNSVMTVRAQLAPSATKLHISLSL ERLSVKVASSFTHAFDGSRLEEWLSHVVGAVYAPK LNVALDVGIPLPKVLNINFSNSVLEIVENAVVLTVAS |
| 4 | Azurocidin precursor | Homo sapiens | 251 | MTRLTVLALLAGLLASSRAGSSPLLDIVGGRKARPR QFPFLASIQNQGRHFCGGALIHARFVMTAASCFQS QNPGVSTVVLGAYDLRRRERQSRQTFSISSMSENG YDPQQNLNDLMLLQLDREANLTSSVTILPLPLQNAT VEAGTRCQVAGWGSQRSGGRLSRFPRFVNVTVTP EDQCRPNNVCTGVLTRRGGICNGDGGTPLVCEGLA HGVASFSLGPCGRGPDFFTRVALFRDWIDGVLNNP GPGPA |
| 5 | Bactericidal permeability-increasing protein precursor (BPI) (CAP 57) | Homo sapiens | 483 | MARGPCNAPRWVSLMVLVAIGTAVTAAVNPGVVVR ISQKGLDYASQQGTAALQKELKRIKIPDYSDSFKIKH LGKGHYSFYSMDIREFQLPSSQISMVPNVGLKFSIS NANIKISGKWKAQKRFLKMSGNFDLSIEGMSISADL KLGSNPTSGKPTITCSSCSSHINSVHVHISKSKVGW LIQLFHKKIESALRNKMNSQVCEKVTNSVSSKLQPY FQTLPVMTKIDSVAGINYGLVAPPATTAETLDVQMK GEFYSENHHNPPPFAPPVMEFPAAHDRMVYLGLSD YFFNTAGLVYQEAGVLKMTLRDDMIPKESKFRLTTK FFGTFLPEVAKKFPNMKIQIHVSASTPPHLSVQPTGL TFYPAVDVQAFAVLPNSSLASLFLIGMHTTGSMEVS AESNRLVGELKLDRLLLELKHSNIGPFPVELLQDIMN YIVPILVLPRVNEKLQKGFPLPTPARVQLYNVVLQPH QNFLLFGADVVYK |
| 6 | bactericidal/permeability-increasing protein precursor | Homo sapiens | 487 | MRENMARGPCNAPRWVSLMVLVAIGTAVTAAVNP GVVVRISQKGLDYASQQGTAALQKELKRIKIPDYSD SFKIKHLGKGHYSFYSMDIREFQLPSSQISMVPNVG LKFSISNANIKISGKWKAQKRFLKMSGNFDLSIEGMS ISADLKLGSNPTSGKPTITCSSCSSHINSVHVHISKS KVGWLIQLFHKKIESALRNKMNSQVCEKVTNSVSSK LQPYFQTLPVMTKIDSVAGINYGLVAPPATTAETLDV QMKGEFYSENHHNPPPFAPPVMEFPAAHDRMVYL GLSDYFFNTAGLVYQEAGVLKMTLRDDMIPKESKFR LTTKFFGTFLPEVAKKFPNMKIQIHVSASTPPHLSVQ PTGLTFYPAVDVQAFAVLPNSSLASLFLIGMHTTGS MEVSAESNRLVGELKLDRLLLELKHSNIGPFPVELL QDIMNYIVPILVLPRVNEKLQKGFPLPTPARVQLYNV VLQPHQNFLLFGADVVYK |
| 7 | beta defensin 126 preproprotein; epididymal secretory protein ESP13.2; beta defensin 26; | Homo sapiens | 111 | MKSLLFTLAVFMLLAQLVSGNWYVKKCLNDVGICKK KCKPEEMHVKNGWAMCGKQRDCCVPADRRANYP VFCVQTKTTRISTVTATTATTTLMMTTASMSSMAPT PVSPTG |

TABLE 1-continued

| | | | | |
|---|---|---|---|---|
| | chromosome 20 open reading frame 8 | | | |
| 8 | beta-defensin | Homo sapiens | 65 | MRTFLFLFAVLFFLTPAKNAFFDEKCNKLKGTCKNN CGKNEELIALCQKFLKCCRTIQPCGSIID |
| 9 | Beta-defensin 103 precursor (Beta-defensin 3) (DEFB-3) (BD-3) (hBD-3) (HBD3) (Defensin like protein) | Homo sapiens | 67 | MRIHYLLFALLFLFLVPVPGHGGIINTLQKYYCRVRG GRCAVLSCLPKEEQIGKCSTRGRKCCRRKK |
| 10 | Beta-defensin 104 precursor (Beta-defensin 4) (DEFB-4) (BD-4) (hBD-4) | Homo sapiens | 72 | MQRLVLLLAVSLLLYQDLPVRSEFELDRICGYGTAR CRKKCRSQEYRIGRCPNTYACCLRKWDESLLNRTKP |
| 11 | beta-defensin 105 | Homo sapiens | 77 | MALIRKTFYFLFAMFFILVQLPSGCQAGLDFSQPFPS GEFAVCESCKLGRGKCRKECLENEKPDGNCRLNFL CCRQR |
| 12 | Beta-defensin 105 precursor (Beta-defensin 5) (DEFB-5) (BD-5) | Homo sapiens | 78 | MALIRKTFYFLFAMFFILVQLPSGCQAGLDFSQPFPS GEFAVCESCKLGRGKCRKECLENEKPDGNCRLNFL CCRQRI |
| 13 | beta-defensin 106 | Homo sapiens | 57 | MRTFLFLFAVLFFLTPAKNAFFDEKCNKLKGTCKNN CGKNEELIALCQKSLKCCRTI |
| 14 | Beta-defensin 106 precursor (Beta-defensin 6) (DEFB-6) (BD-6) | Homo sapiens | 65 | MRTFLFLFAVLFFLTPAKNAFFDEKCNKLKGTCKNN CGKNEELIALCQKSLKCCRTIQPCGSIID |
| 15 | Beta-defensin 107 precursor (Beta-defensin 7) (DEFB-7) (Fragment) | Homo sapiens | 63 | MKIFVPILAALILLAQIFQARTAIHRALISKRMEGHCEA ECLTFEVKIGGCRAELAPFCCKNR |
| 16 | beta-defensin 108 | Homo sapiens | 59 | MRIAVLFFTIFFFMSQVLPAKGKFKEICERPNGSCRD FCLETEIHVGRCLNSRPCCLPL |
| 17 | Beta-defensin 108 precursor (Beta-defensin 8) (DEFB-8) | Homo sapiens | 73 | MRIAVLLFAIFFFMSQVLPARGKFKEICERPNGSCRD FCLETEIHVGRCLNSQPCCLPLGHQPRIESTTPKKD |
| 18 | Beta-defensin 118 precursor (Beta-defensin 18) (DEFB-18) (Epididymal secretory protein 13.6) (ESP13.6) | Homo sapiens | 123 | MKLLLLALPMLVLLPQVIPAYSGEKKCWNRSGHCRK QCKDGEAVKDTCKNLRACCIPSNEDHRRVPATSPT PLSDSTPGIIDDILTVRFTTDYFEVSSKKDMVEESEA GRGTETSLPNVHHSS |
| 19 | Beta-defensin 119 precursor (Beta-defensin 19) (DEFB-19) | Homo sapiens | 84 | MKLLYLFLAILLAIEEPXISGKRHILRCMGNSGICRAS CKKNEQPYLYCRNCQSCCLQSYMRISISGKEENTD WSYEKQWPRLP |
| 20 | Beta-defensin 120 precursor (Beta-defensin 20) (DEFB-20) | Homo sapiens | 88 | MKLLYLFLAILLAIEEPVISVECWMDGHCRLLCKDGE DSIIRCNRKRCCVPSRYLTIQPVTIHGILGWTTPQM STTAPKMKTNITNR |
| 21 | Beta-defensin 123 precursor (Beta-defensin 23) (DEFB-23) | Homo sapiens | 67 | MKLLLLTLTVLLLLSQLTPGGTQRCWNLYGKCRYRC SKKERVYVYCINNKMCCVKPKYQPKERWVVPF |

TABLE 1-continued

| | | | | |
|---|---|---|---|---|
| 22 | Beta-defensin 124 (Beta-defensin 24) (DEFB-24) (Fragment) | Homo sapiens | 43 | EFKRCWKGQGACQTYCTRQETYMHLCPDASLCCL SYALKPPPV |
| 23 | Beta-defensin 125 precursor (Beta-defensin 25) (DEFB-25) | Homo sapiens | 152 | MLTFIICGLLTRVTKGSFEPQKCWKNNVGHCRRRCL DTERYILLCRNKLSCCISIISHEYTRRPAFPVIHLEDIT LDYSDVDSFTGSPVSMLNDLITFDTTKFGETMTPET NTPETTMPPSEATTPETTMPPSETATSETMPPPSQ TALTHN |
| 24 | Beta-defensin 126 precursor (Beta-defensin 26) (DEFB-26) (Epididymal secretory protein 13.2) (ESP13.2) | Homo sapiens | 111 | MKFLLFTLAVFMLLAQLVSGNWYVKKCLNDVGICKK KCKPEEMHVKNGWAMCGKQRDCCVPADRRANYP VFCVQTKTTRISTVTATTATTTLMMTTASMSSMAPT PVSPTG |
| 25 | Beta-defensin 127 precursor (Beta-defensin 27) (DEFB-27) | Homo sapiens | 99 | MGLFMIIAILLFQKPTVTEQLKKCWNNYVQGHCRKIC RVNEVPEALCENGRYCCLNIKELEACKKITKPPRPK PATLALTLQDYVTIIENFPSLKTQST |
| 26 | Beta-defensin 129 precursor (Beta-defensin 29) (DEFB-29) | Homo sapiens | 183 | MKLLFPIFASLMLQYQVNTEFIGLRRCLMGLGRCRD HCNVDEKEIQKCKMKKCCVGPKVVKLIKNYLQYGTP NVLNEDVQEMLKPAKNSSAVIQRKHILSVLPQIKSTS FFANTNFVIIPNATPMNSATISTMTPGQITYTATSTKS NTKESRDSATASPPPAPPPPNILPTPSLELEEAEEQ |
| 27 | Beta-defensin 131 precursor (Beta-defensin 31) (DEFB-31) | Homo sapiens | 70 | MRVLFFVFGVLSLMFTVPPGRSFISNDECPSEYYHC RLKCNADEHAIRYCADFSICCKLKIIEIDGQKKW |
| 28 | Beta-Defensin 2 | Homo sapiens | 37 | PVTCLKSGAICHPVFCPRRYKQIGTCGLPGTKCCKKP |
| 29 | Beta-defensin 2 precursor (BD-2) (hBD-2) (Skin-antimicrobial peptide 1) (SAP1) | Homo sapiens | 64 | MRVLYLLFSFLFIFLMPLPGVFGGIGDPVTCLKSGAI CHPVFCPRRYKQIGTCGLPGTKCCKKP |
| 30 | beta-defensin 25 precursor | Homo sapiens | 156 | MNILMLTFIICGLLTRVTKGSFEPQKCWKNNVGHCR RRCLDTERYILLCRNKLSCCISIISHEYTRRPAFPVIH LEDITLDYSDVDSFTGSPVSMLNDLITFDTTKFGETM TPETNTPETTMPPSEATTPETTMPPSETATSETMPP PSQTALTHN |
| 31 | beta-defensin 28 precursor | Homo sapiens | 93 | MKLFLVLIILLFEVLTDGARLKKCFNKVTGYCRKKCK VGERYEIGCLSGKLCCANDEEEKKHVSFKKPHQHS GEKLSVLQDYIILPTITIFTV |
| 32 | Beta-Defensin 3 | Homo sapiens | 45 | GIINTLQKYYCRVGGRCAVLSCLPKEEQIGKCSTR GRKCCRRKK |
| 33 | beta-defensin 32 precursor | Homo sapiens | 95 | MKFLLLVLAALGFLTQVIPASAGGSKCVSNTPGYCR TCCHWGETALFMCNASRKCCISYSFLPKPDLPQLIG NHWQSRRRNTQRKDKKQQTTVTS |
| 34 | Beta-defensin-1 (Fragment) | Homo sapiens | 47 | GNFLTGLGHRSDHYNCISSGGQCLYSACPIFTKIQG TCYRGKAKCCK |
| 35 | Beta-Defensin-2 | Homo sapiens | 41 | GIGDPVTCLKSGAICHPVFCPRRYKQIGTCGLPGTK CCKKP |
| 36 | Beta-defensin-3 | Homo sapiens | 67 | MRIHYLLFALLFLFLVPVPGHGGIINTLQKYYCRVG GRCAVLSRLPKEEQIGKCSTRGRKCCRRKK |
| 37 | Calgranulin A (Migration inhibitory factor-related protein 8) (MRP-8) | Homo sapiens | 93 | MLTELEKALNSIIDVYHKYSLIKGNFHAVYRDDLKKLL ETECPQYIRKKGADVWFKELDINTDGAVNFQEFLILV IKMGVAAHKKSHEESHKE |

TABLE 1-continued

| | | | | |
|---|---|---|---|---|
| | (Cystic fibrosis antigen) (CFAG) (P8) (Leukocyte L1 complex light chain) (S100 calcium-binding protein A8) (Calprotectin L1L subun | | | |
| 38 | Calgranulin B (Migration inhibitory factor-related protein 14) (MRP-14) (P14) (Leukocyte L1 complex heavy chain) (S100 calcium-binding protein A9) (Calprotectin L1H subunit) | Homo sapiens | 114 | MTCKMSQLERNIETIINTFHQYSVKLGHPDTLNQGE FKELVRKDLQNFLKKENKNEKVIEHIMEDLDTNADK QLSFEEFIMLMARLTWASHEKMHEGDEGPGHHHK PGLGEGTP |
| 39 | Calgranulin C (CAGC) (CGRP) (Neutrophil S100 protein) (Calcium-binding protein in amniotic fluid 1) (CAAF1) (p6) [Contains: Calcitermin] | Homo sapiens | 92 | MTKLEEHLEGIVNIFHQYSVRKGHFDTLSKGELKQL LTKELANTIKNIKDKAVIDEIFQGLDANQDEQVDFQE FISLVAIALKAAHYHTHKE |
| 40 | cathelicidin antimicrobial peptide | Homo sapiens | 170 | MKTQRNGHSLGRWSLVLLLLGLVMPLAIIAQVLSYK EAVLRAIDGINQRSSDANLYRLLDLDPRPTMDGDPD TPKPVSFTVKETVCPRTTQQSPEDCDFKKDGLVKR CMGTVTLNQARGSFDISCDKDNKRFALLGDFFRKS KEKIGKEFKRIVQRIKDFLRNLVPRTES |
| 41 | Cathepsin G precursor (EC 3.4.21.20) (CG) | Homo sapiens | 255 | MQPLLLLLAFLLPTGAEAGEIIGGRESRPHSRPYMA YLQIQSPAGQSRCGGFLVREDFVLTAAHCWGSNIN VTLGAHNIQRRENTQQHITARRAIRHPQYNQRTIQN DIMLLQLSRRVRRNRNVNPVALPRAQEGLRPGTLC TVAGWGRVSMRRGTDTLREVQLRVQRDRQCLRIF GSYDPRRQICVGDRRERKAAFKGDSGGPLLCNNVA HGIVSYGKSSGVPPEVFTRVSSFLPWIRTTMRSFKL LDQMETPL |
| 42 | chromogranin A; parathyroid secretory protein 1 | Homo sapiens | 457 | MRSAAVLALLLCAGQVTALPVNSPMNKGDTEVMKC IVEVISDTLSKPSPMPVSQECFETLRGDERILSILRH QNLLKELQDLALQGAKERAHQQKKHSGFEDELSEV LENQSSQAELKEAVEEPSSKDVMEKREDSKEAEKS GEATDGARPQALPEPMQESKAEGNNQAPGEEEEE EEEATNTHPPASLPSQKYPGPQAEGDSEGLSQGLV DREKGLSAEPGWQAKREEEEEEEEEAAGEEAVP EEEGPTVVLNPHPSLGYKEIRKGESRSEALAVDGA GKPGAEEAQDPEGKGEQEHSQQKEEEEEMAVVPQ GLFRGGKSGELEQEEERLSKEWEDSKRWSKMDQL AKELTAEKRLEGQEEEEDNRDSSMKLSFRARAYGF RGPGPQLRRGWRPSSREDSLEAGLPLQVRGYPEE KKEEEGSANRRPEDQELESLSAIEAELEKVAHQLQA LRRG |
| 43 | Defensin 5 precursor (Defensin, alpha 5) | Homo sapiens | 94 | MRTIAILAAILLVALQAQAESLQERADEATTQKQSGE DNQDLAISFAGNGLSALRTSGSQARATCYCRTGRC ATRESLSGVCEISGRLYRLCCR |
| 44 | Defensin 6 | Homo sapiens | 101 | MRTLTILTAVLLVALQAKAEPLQAEDDPLQAKAYEA DAQEQRGANDQDFAVSFAEDASSSLRALGGSTRAF TCHCRRSCYSTEYSYGTCTVMGINHRFCCL |
| 45 | Defensin 6 precursor | Homo sapiens | 100 | MRTLTILTAVLLVALQAKAEPLQAEDDPLQAKAYEA DAQEQRGANDQDFAVSFAEDASSSLRALGSTRAFT |

TABLE 1-continued

| | | | | |
|---|---|---|---|---|
| | (Defensin, alpha 6) | | | CHCRRSCYSTEYSYGTCTVMGINHRFCCL |
| 46 | defensin alpha-3 precursor (mistranslated) | Homo sapiens | 65 | CCSPGADCSGHPRSGCFPCMGRKLGSKASRLKEK HGLLLQNTSVHCRRTSLWNLHLPGKTLGILL |
| 47 | defensin beta 107 | Homo sapiens | 60 | MKIFFFILAALILLAQIFQARTAIHRALISKRMEGHCEA ECLTFEVKIGGCRAELAPFCC |
| 48 | defensin beta 108 | Homo sapiens | 52 | GKFKEICERPNGSCRDFCLETEIHVGRCLNSQPCCL PLGHQPRIESTTPKKD |
| 49 | Defensin beta 112 (Fragment) | Homo sapiens | 21 | SCTAIGGRCKNQCDDSEFRIS |
| 50 | Defensin beta 114 (Fragment) | Homo sapiens | 39 | KRYGRCKRDCLESEKQIDICSLPGKICCTEKLYEED DMF |
| 51 | defensin beta 118 | Homo sapiens | 101 | GEKKCWNRSGXCRKQCKDGEAVKDTCKNXRACCI PSNEDHRRVPATSPTPLSDSTPGIIDDILTVRFTTDY FEVSSKKDMVEESEAGRGTETSLPNVHHSS |
| 52 | defensin beta 126 | Homo sapiens | 94 | SLLFTLAVFMLLAQLVSGNWYVKKCLNDVGICKKC KPEEMHVKNGWAMCGKQRDCCVPADRRANYPVF CVQTKTTRISTVTATTATTTLMMTT |
| 53 | defensin beta 127 | Homo sapiens | 59 | EQLKKCWNNYVQRHCRKICRVNEVPEALCENGRY CCLNIKELEACKKITKPPSPKQHLH |
| 54 | defensin beta 129 | Homo sapiens | 155 | MKLLFPIFASLMLQYQVNTEFIGLRRCLMGLGRCRD HCNVDEKEIQKCKMKKCCVGPKVVKLIKNYLQYGTP NVLNEDVQEMLKPAKNSSAVIQRKHILSVLPQIKSTS FFANTNFVIIPNATPMNSATISTMTPGQITYTATSTKS NTKESRDS |
| 55 | defensin beta-1 | Homo sapiens | 36 | DHYNCVSSGGQCLYSACPIFTKIQGTCYRGKAKCCK |
| 56 | Defensin HNP-3 - Chain B | Homo sapiens | 30 | DCYCRIPACIAGERRYGTCIYQGRLWAFCC |
| 57 | EP2E | Homo sapiens | 80 | MKVFFLFAVLFCLVQTNSGDVPPGIRNTICRMQQGI CRLFFCHSGEKKRDICSDPWNRCCVSNTDEEGKEK PEMDGRSGI |
| 58 | gene TAP1 protein | Homo sapiens | 33 | GYDTEVGEAGSQLSGGQRQAVALARALIRKPCV |
| 59 | Hepcidin precursor (Liver-expressed antimicrobial peptide) (LEAP-1) (Putative liver tumor regressor) (PLTR) [Contains: Hepcidin 25 (Hepc25); Hepcidin 20 (Hepc20)] | Homo sapiens | 84 | MALSSQIWAACLLLLLLLASLTSGSVFPQQTGQLAE LQPQDRAGARASWMPMFQRRRRRDTHFPICIFCC GCCHRSKCGMCCKT |
| 60 | High mobility group protein 1 (HMG-1) | Homo sapiens | 215 | MGKGDPKKPRGKMSSYAFFVQTCREEHKKKHPDA SVNFSEFSKKCSERWKTMSAKEKGKFEDMAKADK ARYEREMKTYIPPKGETKKKFKDPNAPKRPPSAFFL FCSEYRPKIKGEHPGLSIGDVAKKLGEMWNNTAAD DKQPYEKKAAKLKEKYEKDIAAYRAKGKPDAAKKG VVKAEKSKKKKEEEEDEEDEEDEEEEEDEEDEDEE EDDDDE |
| 61 | liver-expressed antimicrobial peptide 2 isoform | Homo sapiens | 81 | MWHLKLCAVLMIFLLLLGQIDGSPIPEVSSAKRRPRR MTPFWRGVSLRPIGASCRDDSECITRLCRKGQQSP PTMLRSMEY |

TABLE 1-continued

| 62 | Liver-expressed antimicrobial peptide 2 precursor (LEAP-2) | Homo sapiens | 77 | MWHLKLCAVLMIFLLLLGQIDGSPIPEVSSAKRRPRR MTPFWRGVSLRPIGASCRDDSECITRLCRKRRCSL SVAQE |
| --- | --- | --- | --- | --- |
| 63 | Lysozyme C precursor (EC 3.2.1.17) (1,4-beta-N-acetylmuramidase C) | Homo sapiens | 148 | MKALIVLGLVLLSVTVQGKVFERCELARTLKRLGMD GYRGISLANWMCLAKWESGYNTRATNYNAGDRST DYGIFQINSRYWCNDGKTPGAVNACHLSCSALLQD NIADAVACAKRVVRDPQGIRAWVAWRNRCQNRDV RQYVQGCGV |
| 64 | Neutrophil defensin 1 precursor (HNP-1) (HP-1) (HP1) (Defensin, alpha 1) [Contains: HP 1-56; Neutrophil defensin 2 (HNP-2) (HP-2) (HP2)] | Homo sapiens | 94 | MRTLAILAAILLVALQAQAEPLQARADEVAAAPEQIA ADIPEVVVSLAWDESLAPKHPGSRKNMACYCRIPA CIAGERRYGTCIYQGRLWAFCC |
| 65 | Neutrophil defensin 3 precursor (HNP-3) (HP-3) (HP3) (Defensin, alpha 3) [Contains: HP 3-56; Neutrophil defensin 2 (HNP-2) (HP-2) (HP2)] | Homo sapiens | 94 | MRTLAILAAILLVALQAQAEPLQARADEVAAAPEQIA ADIPEVVVSLAWDESLAPKHPGSRKNMDCYCRIPA CIAGERRYGTCIYQGRLWAFCC |
| 66 | Neutrophil defensin 4 precursor (HNP-4) (HP-4) (Defensin, alpha 4) | Homo sapiens | 97 | MRIIALLAAILLVALQVRAGPLQARGDEAPGQEQRG PEDQDISISFAWDKSSALQVSGSTRGMVCSCRLVF CRRTELRVGNCLIGGVSFTYCCTRVD |
| 67 | Retrocyclin | Homo sapiens | 56 | MPCFSWWPCRLRRSHFRQELMKLQPRSSLEQMIR KWLMPLHGMKVPLFRFQTQREA |
| 68 | Ribonuclease 7 precursor (EC 3.1.27.—) (RNase 7) (Skin-derived antimicrobial protein 2) (SAP-2) | Homo sapiens | 156 | MAPARAGFCPLLLLLLLGLWVAEIPVSAKPKGMTSS QWFKIQHMQPSPQACNSAMKNINKHTKRCKDLNTF LHEPFSSVAATCQTPKIACKNGDKNCHQSHGPVSL TMCKLTSGKYPNCRYKEKRQNKSYVVACKPPQKK DSQQFHLVPVHLDRVL |
| 69 | Salivary gland antimicrobial salvic | Homo sapiens | 46 | MHDFWVLWVLLEYIYNSACSVLSATSSVSSRVLNR SLQVKVVKITN |
| 70 | Secretogranin I precursor (SgI) (Chromogranin B) (CgB) [Contains: GAWK peptide; CCB peptide] | Homo sapiens | 677 | MQPTLLLSLLGAVGLAAVNSMPVDNRNHNEGMVTR CIIEVLSNALSKSSAPPITPECRQVLKTSRKDVKDE TTENENTKFEVRLLRDPADASEAHESSSRGEAGAP GEEDIQGPTKADTEKWAEGGGHSRERADEPQWSL YPSDSQVSEEVKTRHSEKSQREDEEEEEGENYQK GERGEDSSEEKHLEEPGETQNAFLNERKQASAIKK EELVARSETHAAGHSQEKTHSREKSSQESGEEAGS QENHPQESKGQPRSQEESEEGEEDATSEVDKRRT RPRHHGRSRPDRSSQGGSLPSEEKGHPQEESEE SNVSMASLGEKRDHHSTHYRASEEEPEYGEEIKGY PGVQAPEDLEWERYRGRGSEEYRAPRPQSEESW DEEDKRNYPSLELDKMAHGYGEESEEERGLEPGK GRHHRGRGGEPRAYFMSDTREEKRFLGEGHHRVQ ENQMDKARRHPQGAWKELDRNYLNYGEEGAPGK WQQQGDLQDTKENREEARFQDKQYSSHHTAEKRK RLGELFNPYYDPLQWKSSHFERRDNMNDNFLEGE EENELTLNEKNFFPEYNYDWWEKKPFSEDVNWGY |

TABLE 1-continued

| | | | |
|---|---|---|---|
| | | | EKRNLARVPKLDLKRQYDRVAQLDQLLHYRKKSAE FPDFYDSEEPVSTHQEAENEKDRADQTVLTEDEKK ELENLAAMDLELQKIAEKFSQRG |
| 71 Similar to azurocidin 1 (Cationic antimicrobial protein 37) (Fragment) | Homo sapiens | 226 | AEGKWGLAHGRAEAHVWPGQGGWRLGPPQGRW TGSSPLLDIVGGRKARPRQFPPLASIQNQGRHFCG GALIHARFVMTAASCFQSQNPGVSTVVLGAYDLRR RERQSRQTFSISSSMSENGYDPQQNLNDLMLLQLDR EANLTSSVTILPLPLQNATVEAGTRCQVAGWGSQR SGGRLSRFPRFVNVTVTPEDQCRPNNVCTGVLTRR GGICNVSAPCGGRRGPERY |
| 72 11.5 kDa antibacterial protein | Carcinus maenas | 84 | NKDCKYWCKDNLGLNYCCGQPGVTYPPFTKKHLG RCPAVRDTCTGVRTQLPTYCPHDGACQFRSKCCY DTCLKHHVCKTAEYPY |
| 73 27 kDa antibacterial protein (Fragment) | Cyprinus carpio | 19 | GIGGKPVQTAFVDNDGIYD |
| 74 4 kDa defensin | Androctonus australis | 37 | GFGCPFNQGACHRHCRSIRRRGGYCAGLFKQTCT CYR |
| 75 4 kDa defensin (Antibacterial 4 kDa peptide) | Leiurus quinquestriatus | 38 | GFGCPLNQGACHRHCRSIRRRGGYCAGFFKQTCT CYRN |
| 76 7.5 kDa bactinecin (Fragment) | Ovis aries | 164 | METQMASPSLGRCSLWLLLLGLLLPSASAQALSYR EAVLRAVGQLNEKSSEVNLYRLLELDPPPKDAEDQ GARKPVSFRVKETVCPRTSQQPPEQCDFKENGLVK QCVGTVSLDTSNDEFDLNCNELQSVRRLRPRRPRL PRPRPRPRPRPRSLPLPRPQPRRI |
| 77 Abaecin | Bombus pascuorum | 39 | FVPYNPPRPGQSKPFPSFPGHGPFNPKIQWPYPLP NPGH |
| 78 Abaecin precursor | Apis mellifera | 53 | MKVVIFIFALLATICAAFAYVPLPNVPQPGRRPFPTF PGQGPFNPKIKWPQGY |
| 79 Acaloleptin A1 | Acalolepta luxuriosa | 71 | SLQPGAPNVNNKDQPWQVSPHISRDDSGNTRTDIN VQRHGENNDFEAGWSKVVRGPNKAKPTWHIGGTH RW |
| 80 Achacin precursor | Achatina fulica | 531 | MLLLNSALFILCLVCWLPGTSSSRVLTRREGPQCSR SVDVAVVGAGPSGTYSAYKLRNKGQTVELFEYSNR IGGRLFTTHLPNVPDLNLESGGMRYFKNHHKIFGVL VKELNLSNKEFTEGFGKPGRTRFFARGKSLTEEMT SGDVPYNLSTEEKANQANLAGYYLKKLTGFDGEVL TIPQANKLEVDDGRKLYQLTVDEALDKVGTPEGKEF LKAFSTGNTEFIEGVSAVNYFLVELGEREEEILTLTD GMSALPQALADAFLKSSTSHALTLNRKLQSLSKTDN GLYLLEFLETNTHEGYTEESNITDLVCARKVILAIPQS ALIHLDWKPLRSETVNEAFNAVKFIPTSKVFLTFPTA WWLSDAVKNPAFVVKSTSPFNQMYDWKSSNVTGD AAMIASYADTSDTKFQENLNSKGELIPGSAPGANRV TVALKEELLSQLSQAYGIERSDIPEPKSGTSQFWSS YPFEGDWTVWKAGYHCEYTQYIIERPSLIDDVFVVG SDHVNCIENAWTESAFLSVENVFEKYF |
| 81 Acyl-CoA-binding protein (ACBP) (Diazepam binding inhibitor) (DBI) (Endozepine) (EP) [Contains: DBI(32-86)] | Sus scrofa | 87 | MSQAEFEKAAEEVKNLKTKPADDEMLFIYSHYKQAT VGDINTERPGILDLKGKAKWDAWNGLKGTSKEDAM KAYINKVEELKKKYGI |
| 82 Adenoregulin precursor (Dermaseptin BII) (Dermaseptin B2) | Phyllomedusa bicolor | 81 | MAFLKKSLFLVLFLGLVSLSICEEEKRENEDEEEQED DEQSEMKRGLWSKIKEVGKEAAKAAAKAAGKAALG AVSEAVGEQ |

TABLE 1-continued

| | | | |
|---|---|---|---|
| 83 Alpha-defensin 1 | *Macaca mulatta* | 96 | MRTLAILAAILLVALQAQAEPLQARTDEATAAQEQIP TDNPEVVVSLAWDESLAPKDSVPGLRKNMACYCRI PACLAGERRYGTCFYMGRVWAFCC |
| 84 Alpha-defensin 1A | *Macaca mulatta* | 96 | MRTLAILAAILLVALQAQAEPLQARTDEATAAQEQIP TDNPEVVVSLAWDESLAPKDSVPGLRKNMACYCRI PACLAGERRYGTCFYLGRVWAFCC |
| 85 Alpha-defensin 2 | *Macaca mulatta* | 94 | MRTLAILAAILLFALLAQAKSLQETADDAATQEQPGE DDQDLAVSFEENGLSTLRASGSQARRTCRCRFGR CFRRESYSGSCNINGRIFSLCCR |
| 86 Alpha-S2 casein precursor [Contains: Casocidin-I] | *Bos taurus* | 222 | MKFFIFTCLLAVALAKNTMEHVSSSEESIISQETYKQ EKNMAINPSKENLCSTFCKEVVRNANEEEYSIGSSS EESAEVATEEVKITVDDKHYQKALNEINQFYQKFPQ YLQYLYQGPIVLNPWDQVKRNAVPITPTLNREQLST SEENSKKTVDMESTEVFTKKTKLTEEEKNRLNFLKKI SQRYQKFALPQYLKTVYQHQKAMKPWIQPKTKVIP YVRYL |
| 87 Androctonin | *Androctonus australis* | 25 | RSVCRQIKICRRGGCYYKCTNRPY |
| 88 Andropin precursor | *Drosophila mauritiana* | 57 | MKYFVVLVVLALILAITVGPSDAVFIDILDKMENAIHK AAQAGIGIAKPIEKMILPK |
| 89 Andropin precursor | *Drosophila melanogaster* | 57 | MKYFVVLVVLALILAISVGPSDAVFIDILDKVENAIHNA AQVGIGIFAKPFEKLINPK |
| 90 Andropin precursor | *Drosophila orena* | 67 | MKYFLVLVVVLTLILAISVGQSDALFVDIIDNVENAIHKA AKTGIGMVKPIENIFIPNQQKKSTEASN |
| 91 Andropin precursor | *Drosophila sechellia* | 57 | MKYFVVLVVLALILAITVDPSDAVFIDILDKMENAIHKA AQAGIGLAKPIENMILPK |
| 92 Andropin precursor | *Drosophila simulans* | 60 | MKYFVVLVVLALILAIAVGPSDAVFIDILDKMENAIHK AAQAGIGIAKPIENMILPKLTK |
| 93 Andropin precursor | *Drosophila teissieri* | 62 | MKYFSVLVVLTLILAIVDQSDAFINLLDKVEDALHTGA QAGFKLIRPVERGATPKKSEKPEK |
| 94 Andropin precursor | *Drosophila yakuba* | 60 | MKYFSVLVVLTLILAISVGQSNAIFVDVLDNVETALHN AAKAGFKLIKPIEKMIMPSKEK |
| 95 Anionic antimicrobial peptide | *Bombina maxima* | 144 | MNFKYIFAVSFLIASAYARSVQNDEQSLSQRDVLEE ESLREIRGIGGKILSGLKTALKGAAKELASTYLHRKR TAEEHEEMKRLEAVMRDLDSLDYPEEASERETRGF NQDEIANLFTKKEKRILGPVLGLVSDTLDDVLGILG |
| 96 Antibacterial 6.5 kDa protein (Fragment) | *Carcinus maenas* | 30 | XXVPYPRPFPRPPIGPRPLPFGGGRPFQS |
| 97 Antibacterial peptide BMAP-27 precursor (Myeloid antibacterial peptide 27) | *Bos taurus* | 158 | METQRASLSLGRWSLWLLLLGLALPSASAQALSYR EAVLRAVDQFNERSSEANLYRLLELDPPPKEDDEN PNIPKPVSFRVKETVCPRTSQQPAEQCDFKENGLV KQCVGTVTLDAVKGKINVTCEELQSVGRFKRFRKKF KKLFKKLSPVIPLLHLG |
| 98 Antibacterial peptide BMAP-28 precursor (Myeloid antibacterial peptide 28) | *Bos taurus* | 159 | METQRASLSLGRWSLWLLLLGLALPSASAQALSYR EAVLRAVDQLNEKSSEANLYRLLELDPPPKEDDENP NIPKPVSFRVKETVCPRTSQQSPEQCDFKENGLLKE CVGTVTLDQVGSNFDITCAVPQSVGGLRSLGRKILR AWKKYGPIIVPIIRIG |
| 99 Antibacterial peptide BMAP-34 precursor | *Bos taurus* | 165 | METQRASFSLGRSSLWLLLLGLVVPSASAQDLSYR EAVLRAVDQFNERSSEANLYRLLELDPPPEQDVEH PGARKPVSFTVKETVCPRTTPQPPEQCDFKENGLV KQCVGTVTRYWIRGDFDITCNNIQSAGLFRRLRDSI RRGQQKILEKARRIGERIKDIFRG |
| 100 Antibacterial peptide enbocin precursor (Moricin) | *Bombyx mori* | 59 | MNFTRIIFFLFVVVFATASGKPWNIFKEIERAVARTR DAVISAGPAVRTVAAATSVASG |

TABLE 1-continued

| | | | |
|---|---|---|---|
| 101 | Antibacterial peptide PMAP-23 precursor (Myeloid antibacterial peptide 23) | *Sus scrofa* | 153 | METQRASLCLGRWSLWLLLLGLVVPSASAQALSYR EAVLRAVDRLNEQSSEANLYRLLELDQPPKADEDP GTPKPVSFTVKETVCPRPTRQPPELCDFKENGRVK QCVGTVTLKEIRGNFDITCNQLQSVRIIDLLWRVRRP QKPKFVTVWVR |
| 102 | Antibacterial peptide PMAP-36 precursor (Myeloid antibacterial peptide 36) | *Sus scrofa* | 166 | METQRASLCLGRWSLWLLLLGLVVPSASAQALSYR EAVLRAVDRLNEQSSEANLYRLLELDQPPKADEDP GTPKPVSFTVKETVCPRPTWRPPELCDFKENGRVK QCVGTVTLNPSNDPLDINCDEIQSVGRFRRLRKKTR KRLKKIGKVLKWIPPIVGSIPLGCG |
| 103 | Antibacterial peptide PMAP-37 precursor (Myeloid antibacterial peptide 37) | *Sus scrofa* | 167 | METQRASLCLGRWSLWLLLLALVVPSASAQALSYR EAVLRAVDRLNEQSSEANLYRLLELDQPPKADEDP GTPKPVSFTVKETVCPRPTWRPPELCDFKENGRVK QCVGTVTLDQIKDPLDITCNEIQSVGLLSRLRDFLSD RGRRLGEKIERIGQKIKDLSEFFQS |
| 104 | Antibacterial protein 11.5 kDa (Fragment) | *Carcinus maenas* | 88 | GLFPNKDCKYWCKDNLGLNYCCGQPGVTYPPFTK KHLGRCPAVRDTCTGVRTQLPTYCPHDGACQFRS KCCYDTCLKHHVCKTAEYPY |
| 105 | Antibacterial protein PR-39 precursor | *Sus scrofa* | 172 | METQRASLCLGRWSLWLLLLGLVVPSASAQALSYR EAVLRAVDRLNEQSSEANLYRLLELDQPPKADEDP GTPKPVSFTVKETVCPRPTRQPPELCDFKENGRVK QCVGTVTLNPSIHSLDISCNEIQSVRRRPRPPYLPRP RPPPFFPPRLPPRIPPGFPPRFPPRFGKR |
| 106 | antibacterial protein precursor | *Sus scrofa* | 172 | METQRASLCLGRWSLWLLLLALVVPSASAQALSYR EAVLRAVDRLNEQSSEANLYRLLELDQPPKADEDP GTPKPVSFTVKETVCPRPTRQPPELCDFKENGRVK QCVGTVTLNPSIHSLDISCNEIQSVRRRPRPPYLPRP RPPPFFPPRLPPRIPPGFPPRFPPRFGKR |
| 107 | antibacterial protein, 11K | *Cavia porcellus* | 42 | GLRKKFRKTRKRIQKLGRKIGKTGRKVXKAWREYG QIPYPCR |
| 108 | Antifungal peptide gallerimycin | *Galleria mellonella* | 76 | MKIAFIVAISLAFLAVTSCIEFEKSTESHDIQKRGVTIT VKPPFPGCVFYECIANCRSRGYKNGGYCTINGCQC LR |
| 109 | Antifungal protein precursor (AFP) | *Sarcophaga peregrina* | 85 | MVKLFVIVILALIAVAFGQHGHGGQDQHGYGHGQQ AVYGKGHEGHGVNNLGQDGHGQHGYAHGHSDQH GHGGQHGQHDGYKNRGY |
| 110 | Antimicrobial amphipathic helix-forming peptide | *Xenopus laevis* | 66 | LKCVNLQANGIKMTQECAKEDTKCLTLRSLKKTLKF CASGRTCTTMKIMSLPGEQITCCEGNMCNA |
| 111 | Antimicrobial peptide ALO1 | *Acrocinus longimanus* | 34 | CIKNGNGCQPDGSQGNCCSRYCHKEPGWVAGYCR |
| 112 | Antimicrobial peptide ALO2 | *Acrocinus longimanus* | 34 | CIANRNGCQPDGSQGNCCSGYCHKEPGWVAGYC |
| 113 | Antimicrobial peptide ALO3 | *Acrocinus longimanus* | 36 | CIKNGNGCQPNGSQGNCCSGYCHKQPGWVAGYC RRK |
| 114 | Antimicrobial peptide attacin AttA | *Glossina morsitans* | 208 | MQSFKICFFISCLSVVLVKGQFGGTVSSNPNGGLDV NARLSKTIGDPNANVVGGVFAAGNTDGGPATRGAF LAANKDGHGLSLQHSKTDNFGSSLTSSAHAHLFND KTHKLDANAFHSRTHLDNGFKFDRVGGGLRYDHVT GHGASLTASRIPQLDMNTLGLTGKANLWSSPNRAT TLDLTGGVSKHFGGPFDGQTNKQIGLGLNSRF |
| 115 | Antimicrobial peptide cecropin 6 | *Manduca sexta* | 67 | MKFSRVLFFVFACFAAFTVTAAKPWDFLKELEGAG QRIRDAIISAQPAVETIAQATAIFKGQSKEED |
| 116 | Antimicrobial peptide CHP1 (Chicken heterophil peptide 1) | *Gallus gallus* | 39 | GRKSDCFRKSGFCAFLKCPSLTLISGKCSRFYLCCK RIR |

TABLE 1-continued

| | | | |
|---|---|---|---|
| 117 | Antimicrobial peptide CHP2 (Chicken heterophil peptide 2) (Fragment) | *Gallus gallus* | 34 | GRKSDCFRKNGFCAFLKCPYLTLISGLCSXFHLC |
| 118 | Antimicrobial peptide defensin DefA | *Glossina morsitans* | 87 | MKFYLVLAFLTLCAVAVTALPAGDETRIDLETLEEDL RLVDGAQVTGELKRDKRVTCNIGEWVCVAHCNSKS KKSGYCSRGVCYCTN |
| 119 | Antimicrobial peptide diptericin DipA (Fragment) | *Glossina morsitans* | 76 | PQSPPAQIKDPKIYASGGGSPKDGYNVNVDVRKNV WVSQNGRHSIDATGGYSQHLGGPYGNSRPDFRGG ASYTYRE |
| 120 | Antimicrobial peptide eNAP-1 (Fragment) | *Equus caballus* | 46 | DVQCGEGHFCHDXQTCCRASQGGXACCPYSQGV CCADQRHCCPVGF |
| 121 | Antimicrobial peptide eNAP-2 (Fragment) | *Equus caballus* | 46 | EVERKHPLGGSRPGRCPTVPPGTFGHCACLCTGD ASEPKGQKCCSN |
| 122 | Antimicrobial peptide gloverin (Fragment) | *Manduca sexta* | 171 | AILFAAIVACACAQVSMPPQYAQIYPEYYKYSKQVR HPRDVTWDKQVGNNGKVFGTLGQNDQGLFGKGG YQHQFFDDHRGKLTGQGYGSRVLGPYGDSTNFGG RLDWANKNANAALDVTKSIGGRTGLTASGSGVWQL GKNTDLSAGGTLSQTLGHGKPDVGFQGLFQHRW |
| 123 | Antimicrobial peptide hepcidin | *Sus scrofa* | 82 | MALSVQIRAACLLLLLLVSLTAGSVLPSQTRQLTDLR TQDTAGATAGLTPVAQRLRRDTHFPICIFCCGCCRK AICGMCCKT |
| 124 | Antimicrobial peptide lumbricin1 | *Lumbricus rubellus* | 76 | MSLCISDYLYLTLTFSKYERQKDKRPYSERKNQYTG PQFLYPPERIPPQKVIKWNEEGLPIYEIPGEGGHAEP AAA |
| 125 | Antimicrobial peptide MGD2b | *Mytilus galloprovincialis* | 82 | MKAVFVLLVVGLCIMMMDVATAGFGCPNNYACHQH CKSIRGYCGGYCASWFRLRCTCYRCGGRRDDVEDI FDIYDNVAVERF |
| 126 | Antimicrobial peptide moricin | *Manduca sexta* | 67 | MKLTSLFIFVIVALSLLFSSTDAAPGKIPVKAIKQAGK VIGKGLRAINIAGTTHDVVSFFRPKKKKH |
| 127 | Antimicrobial peptide NK-lysin | *Equus caballus* | 160 | MKKMGCGGRLSSCPTMTSRALLLLASALLGTPGLT FSGLNPESYDLATAHLSDGEQFCQGLTQEDLQGDL LTERERQGIACWSCRKILQKLEDLVGEQPNEATINE AASRVCRNLGLLRGACKKIMRTCLRLISRDILAGKKP QEVCVDIKLCKHKAGLI |
| 128 | Antimicrobial peptide PGQ | *Xenopus laevis* | 24 | GVLSNVIGYLKKLGTGALNAVLKQ |
| 129 | Antimicrobial peptide THP1 precursor (Turkey heterophil peptide 1) | *Meleagris gallopavo* | 65 | MRIVYLLFPFILLLAQGAAGSSLALGKREKCLRRNGF CAFLKCPTLSVISGTCSRFQVCCKTLLG |
| 130 | Antimicrobial peptide THP2 precursor (Turkey heterophil peptide 2) | *Meleagris gallopavo* | 64 | MRILYLLFSLLFLALQVSPGLSSPKRDMLFCKRGTC HFGRCPSHLIKVGSCFGFRSCCKWPWDA |
| 131 | Antimicrobial peptide THP3 (Turkey heterophil peptide 3) (Fragment) | *Meleagris gallopavo* | 25 | LSCKRGTCHFGRCPSHLIKGSCSGG |
| 132 | Antimicrobial protein attacin 2 (Fragment) | *Manduca sexta* | 207 | KMFTKFVVLVCLLVGAKARPQLGALTFNSDGTSGA AVKVPFGGNKNNIFSAIGGADFNANHKLSSATAGVA LDNIRGHGLSLTDTHIPGFGDKLTAAGKLNLFHNNN HDLTANAFATRNMPNIPQVPNFNTVGGGLDYMFKN |

TABLE 1-continued

| | | | |
|---|---|---|---|
| | | | KVGASLGAAHTDFINRNDYSVGGKLNLFRNPSTSLD FNAGFKKFDTPFMRSGWEPNMGFSLSKFF |
| 133 Antimicrobial protein CAP18 precursor (18 kDa lipopolysaccharide-binding protein) (18 kDa cationic protein) CAP18-A | Oryctolagus cuniculus | 171 | METHKHGPSLAWWSLLLLLLGLLMPPAIAQDLTYRE AVLRAVDAFNQQSSEANLYRLLSMDPQQLEDAKPY TPQPVSFTVKETECPRTTWKLPEQCDFKEDGLVKR CVGTVTRYQAWDSFDIRCNRAQESPEPTGLRKRLR KFRNKIKEKLKKIGQKIQGFVPKLAPRTDY |
| 134 Antimicrobial-like peptide PP-1 | Pheretima tschiliensis | 67 | MYSKYERQKDKRPYSERKDQYTGPQFLYPPDRIPP SKAIKWNEEGLPMYEVLPDGAGAKTAVEAAAE |
| 135 Apidaecin | Bombus pascuorum | 17 | GNRPVYIPPPRPPHPRL |
| 136 apidaecin 1b precursor | Apis mellifera | 26 | EAKPEAKPGNNRPVYIPQPRPPHPRL |
| 137 Apidaecin precursor, type 14 | Apis mellifera | 168 | MKNFALAILVVTFVVAVFGNTNLDPPTRPARLRREA KPEAEPGNNRPIYIPQPRPPHPRLRREAEPKAEPGN NRPIYIPQPRPPHPRLRREAESEAEPGNNRPVYIPQ PRPPHPRLRREPEAEPGNNRPVYIPQPRPPHPRLR REPEAEPGNNRPVYIPQPRPPHPRI |
| 138 Apidaecin precursor, type 22 | Apis mellifera | 144 | MKNFALAILVVTFVVAVFGNTNLDPPTRPTRLRREA EPEAEPGNNRPVYIPQPRPPHPRLRREAEPEAEPG NNRPVYIPQPRPPHPRLRREAEPEAEPGNNRPVYIP QPRPPHPRLRREAEPEAEPGNNRPVYIPQPRPPHP RI |
| 139 Apidaecin precursor, type 73 (Fragment) | Apis mellifera | 283 | KNFALAILVVTFVVAVFGNTNLDPPTRPTRLRREAKP EAEPGNNRPVYIPQPRPPHPRLRREAEPEAEPGNN RPVYIPQPRPPHPRLRREAELEAEPGNNRPVYISQP RPPHPRLRREAEPEAEPGNNRPVYIPQPRPPHPRL RREAELEAEPGNNRPVYISQPRPPHPRLRREAEPE AEPGNNRPVYIPQPRPPHPRLRREAEPEAEPGNNR PVYIPQPRPPHPRLRREAEPEAEPGNNRPVYIPQPR PPHPRLRREAKPEAKPGNNRPVYIPQPRPPHPRI |
| 140 Apolipoprotein A-II (Apo-AII) (Antimicrobial peptide BAMP-1) | Bos taurus | 76 | QAEESNLQSLVSQYFQTVADYGKDLVEKAGSELQ TQAKAYFEKTQEELTPFFKKAGTDLLNFLSSFIDPKK QPAT |
| 141 ASABF precursor (ASABF-alpha) | Ascaris suum | 93 | MKTAIIVVLLVIFASTNAAVDFSSCARMDVPGLSKVA QGLCISSCKFQNCGTGHCEKRGGRPTCVCDRCGR GGGEWPSVPMPKGRSSRGRRHS |
| 142 ASABF-epsilon (ASABF epsilon2) | Ascaris suum | 65 | MVTKGIVLFMLVILFASTDAATCGYDDAKLNRPTIGC ILSCKVQGCETGACYLRDSRPICVCKRC |
| 143 ASABF-zeta | Ascaris suum | 94 | MKAILIALLLTTFTVVNGGVVLTSCARMDTPVLSKAA QGLCITSCKYQNCGTGFCQKVGGRPTCMCRRCAN GGGSWPVIPLDTLVKLALKRGKR |
| 144 ASABF-zeta2 (Fragment) | Ascaris suum | 35 | TSCKYQNCGTGFCQKVGGRPTCMCRRCANGGGS WP |
| 145 Attacin A precursor | Drosophila melanogaster | 224 | MQKTSILIVALVALFAITEALPSLPTTGPIRVRRQVLG GSLTSNPAGGADARLDLTKGIGNPNHNVVGQVFAA GNTQSGPVTTGGTLAYNNAGHGASLTKTHTPGVKD VFQQEAHANLFNNGRHNLDAKVFASQNKLANGFEF QRNGAGLDYSHINGHGASLTHSNFPGIGQQLGLDG RANLWSSPNRATTLDLTGSASKWTSGPFANQKPNF GAGLGLSHHFG |
| 146 Attacin A precursor | Trichoplusia ni | 254 | MFTYKLILGLVLVVSASARYLVFEDLEGESYLVPNQA EDEQVLEGEPFYENAVQLASPVRRQAQGSVTLNS DGSMGLGAKVPIVGNEKNVLSALGSVDLNDQLKPA SRGMGLALDNVNGHGLSVMKETVPGFGDRLTGAG RVNVFHNDNHDISAKAFVTKNMPDFPNVPNFNTVG GGVDYMYKNKVGASLGMANTPFLDRKDYSAMGNL NVFRSPTTSVDFNAGFKKFDTPVFKSNWEPNFGLT FSRSFGNKW |

TABLE 1-continued

| | | | |
|---|---|---|---|
| 147 | Attacin B precursor | Drosophila melanogaster | 218 MQKTSILILALFAIAEAVPTTGPIRVRRQVLGGSLASN PAGGADARLNLSKGIGNPNHNVVGQVFAAGNTQS GPVTTGGTLAYNNAGHGASLTKTHTPGVKDVFQQE AHANLFNNGRHNLDAKVFASQNKLANGFEFQRNGA GLDYSHINGHGASLTHSNFPGIGQQLGLDGRANLW SSPNRATTLDLTGSASKWTSGPFANQKPNFGAGLG LSHHFG |
| 148 | Attacin B precursor (Immune protein P5) | Hyalophora cecropia | 233 MFAKLFLVSVLLVGVNSRYVLVEEPGYYDKQYEEQ PQQWVNSRVRRQAGALTINSDGTSGAVVKVPITGN ENHKFSALGSVDLTNQMKLGAATAGLAYDNVNGHG ATLTKTHIPGFGDKMTAAGKVNLFHNDNHDFSAKAF ATKNMPNIPQVPNFNTVGAGVDYMFKDKIGASANA AHTDFINRNDYSLGGKLNLFKTPTTSLDFNAGWKKF DTPFFKSSWEPSTSFSFSKYF |
| 149 | Attacin E and F precursor (Immune protein P5) | Hyalophora cecropia | 235 MFGKIVFLLLVALCAGVQSRYLIVSEPVYYIEHYEEP ELLASSRVRRDAHGALTLNSDGTSGAVVKVPFAGN DKNIVSAIGSVDLTDRQKLGAATAGVALDNINGHGL SLTDTHIPGFGDKMTAAGKVNVFHNDNHDITAKAFA TRNMPDIANVPNFNTVGGGIDYMFKDKIGASASAAH TDFINRNDYSLDGKLNLFKTPDTSIDFNAGFKKFDTP FMKSSWEPNFGFSLSKYF |
| 150 | Attacin precursor (Nuecin) | Bombyx mori | 214 MSKSVALLLLCACLASGRHVPTRARRQAGSFTVNS DGTSGAALKVPLTGNDKNVLSAIGSADFNDRHKLSA ASAGLALDNVNGHGLSLTGTRIPGFGEQLGVAGKV NLFHNNNHDLSAKAFAIRNSPSAIPNAPNFNTLGGG VDYMFKQKVGASLSAAHSDVINRNDYSAGGKLNLF RSPSSSLDFNAGFKKFDTPFYRSSWEPNVGFSFSK FF |
| 151 | Attacin-A CG10146-PA | Drosophila melanogaster | 221 MQNTSILIVALVALFAITEALPTTGPIRVRRQVLGGSL TSNPAGGADARLDLTKGIGNPNHNVVGQVFAAGNT QSGPVTTGGTLAYNNAGHGASLTKTHTPGVKDVFQ QEAHANLFNNGRHNLDAKVFASQNKLANGFEFQRN GAGLDYSHINGHGASLTHSNFPGIGQQLGLDGRAN LWSSPNRATTLDLTGSASKWTSGPFANQKPNFGA GLGLSHHFG |
| 152 | Attacin-B CG18372-PA | Drosophila melanogaster | 218 MQKTSILILALFAIAEAVPTTGPIRVRRQVLGGSLASN PAGGADARLNLSKGIGNPNHNVVGQVFAAGNTQS GPVTTGGTLAYNNAGHGASLTKTHTPGVKDVFQQE AHANLFNNGRHNLDAKVFASQNKLANGFEFQRNGA GLDYSHINGHGGSLTHSNFPGIGQQLGLDGRANLW SSPNRATTLDLTGSASKWTSGPFANQKPNFGAGLG LSHHFG |
| 153 | Azurocidin (Cationic antimicrobial protein CAP37) (Heparin-binding protein) (HBP) | Sus scrofa | 219 IVGGRRAQPQEFPFLASIQKQGRPFCAGALVHPRFV LTAASCFRGKNSGSASVVLGAYDLRQQEQSRQTFS IRSISQNGYDPRQNLNDVLLLQLDREARLTPSVALV PLPPQNATVEAGTNCQVAGWGTQRLRRLFSRFPR VLNVTVTSNPCLPRDMCIGVFSRRGRISQGDRGTPL VCNGLAQGVASFLRRRFRRSSGFFTRVALFRNWID SVLNNPP |
| 154 | bactenecin 5 | Bos taurus | 42 RFRPPIRRPPIRPPFYPPFRPPIRPPIFPPIRPPFRPP LRFP |
| 155 | Bactenecin 5 precursor (BAC5) | Ovis aries | 176 METQGASLSLGRWSLWLLLLGLVLPSASAQALSYR EAVLRAVGQLNERSSEANLYRLLELDPAPNDEVDP GTRKPVSFTVKETVCPRTTQQPPEECDFKENGLVK QCVGTVTLDPSNDQFDINCNELQSVRFRPPIRRPPI RPPFRPPFRPPFRPPVRPPIRPPFRPPFRPPIGPFPGRR |
| 156 | Bactenecin 5 precursor (BAC5) (PR-42) | Bos taurus | 176 METQRASLSLGRCSLWLLLLGLVLPSASAQALSYRE AVLRAVDQFNERSSEANLYRLLELDPTPNDDLDPGT RKPVSFRVKETDCPRTSQQPLEQCDFKENGLVKQC VGTVTLDPSNDQFDINCNELQSVRFRPPIRRPPIRP PFYPPFRPPIRPPIFPPIRPPFRPPLGPFPGRR |
| 157 | Bactenecin 5 precursor (CHBAC5) | Capra hircus | 176 METQGASLSLGRWSLWLLLLGLVVPLASAQALSYR EAVLRAVGQLNERSSEANLYRLLELDPAPNDEVDP GTRKPVSFTVKETVCPRTTQQPPEECDFKENGLVK QCVGTVTLDPSNDQFDINCNELQSVRFRPPIRRPPI RPPFNPPFRPPVRPPFRPPFRPPIGPFPGRR |

TABLE 1-continued

| | | | |
|---|---|---|---|
| 158 bactenecin 7 | Bos taurus | 59 | RRIRPRPPRLPRPRPRPLPFPRPGPRPIPRPLPFPR PGPRPIPRPLPFPRPGPRPIPRP |
| 159 Bactenecin 7 precursor (BAC7) | Ovis aries | 190 | METQMASPSLGRCSLWLLLLGLLLPSASAQALSYR EAVLRAVGQLNEKSSEVNLYRLLELDPPPKDAEDQ GARKPVSFRVKETVCPRMSQQPPEQCDFKENGLV KQCVGTVSLDTSNDEFDLNCNELQSVRRLRPRRPR LPRPRPRPRPRPRSLPLPRPQPRRIPRPILLPWRPP RPIPRPQPQPIPRWL |
| 160 Bactenecin 7 precursor (BAC7) (PR-59) | Bos taurus | 190 | METQRASLSLGRWSLWLLLLGLVLPSASAQALSYR EAVLRAVDRINERSSEANLYRLLELDPPPKDVEDRG ARKPTSFTVKETVCPRTSQPPEQCDFKENGLVKQ CVGTITLDQSDDLFDLNCNELQSVRRIRPRPPRLPR PRPRPLPFPRPGPRPIPRPLPFPRPGPRPIPRPLPF PRPGPRPIPRPL |
| 161 beta defensin 39 | Mus musculus | 74 | MKISYFLLLILSLGSSQINPVSGDDSIQCFQKNNTCH TNQCPYFQDEIGTCYDRRGKCCQKRLLHIRVPRKK KV |
| 162 Beta defensin 9 precursor (Hypothetical defensin-like structure containing protein) | Mus musculus | 78 | MPVTKSYFMTVVVVLILVDETTGGLFGFRSSKRQEP WIACELYQGLCRNACQKYEIQYLSCPKTRKCCLKYP RKITSF |
| 163 Beta defensin-2 precursor | Capra hircus | 64 | MRLHHLLLALFFLVLSAGSGFTQGIINHRSCYRNKG VCAPARCPRNMRQIGTCHGPPVKCCRKK |
| 164 Beta-defensin 1 (BNDB-1) (BNBD-1) | Bos taurus | 38 | DFASCHTNGGICLPNRCPGHMIQIGICFRPRVKCCR SW |
| 165 Beta-defensin 1 precursor (BD-1) | Capra hircus | 64 | MRLHHLLLVLFFLVLSAGSGFTQGIRSRRSCHRNKG VCALTRCPRNMRQIGTCFGPPVKCCRKK |
| 166 Beta-defensin 1 precursor (BD-1) (Defensin, beta 1) | Sus scrofa | 64 | MRLHRLLLVFLLMVLLPVPGLLKNIGNSVSCLRNKG VCMPGKCAPKMKQIGTCGMPQVKCCKRK |
| 167 Beta-defensin 1 precursor (BD-1) (hBD-1) (Defensin, beta 1) | Pan troglodytes | 68 | MRTSYLLLFTLCLLLSEMASGGNFLTGLGHRSDHYN CVSSGGQCLYSACPIFTKIQGTCYRGKAKCCK |
| 168 Beta-defensin 1 precursor (BD-1) (mBD-1) | Mus musculus | 69 | MKTHYFLLVMICFLFSQMEPGVGILTSLGRRTDQYK CLQHGGFCLRSSCPSNTKLQGTCKPDKPNCCKS |
| 169 Beta-defensin 1 precursor (BD-1) (RBD-1) | Rattus norvegicus | 69 | MKTHYFLLVMLFFLFSQMELGAGILTSLGRRTDQYR CLQNGGFCLRSSCPSHTKLQGTCKPDKPNCCRS |
| 170 Beta-defensin 1 precursor (BD-1) (RhBD-1) (Defensin, beta 1) | Macaca mulatta | 68 | MRTSYLLLFTLCLLLSEMASGDNFLTGLGHRSDHYN CVRSGGQCLYSACPIYTRIQGTCYHGKAKCCK |
| 171 Beta-defensin 1 precursor (BD-1) (sBD1) | Ovis aries | 64 | MRLHHLLLVLFFVVLSAGSGFTQGVRNRLSCHRNK GVCVPSRCPRHMRQIGTCRGPPVKCCRKK |
| 172 Beta-defensin 10 (BNDB-10) (BNBD-10) | Bos taurus | 40 | QGVRSYLSCWGNRGICLLNRCPGRMRQIGTCLAPR VKCCR |
| 173 Beta-defensin 11 (BNDB-11) (BNBD-11) | Bos taurus | 38 | GPLSCRRNGGVCIPIRCPGPMRQIGTCFGRPVKCC RSW |

TABLE 1-continued

| | | | |
|---|---|---|---|
| 174 Beta-defensin 118 precursor (Epididymal secretory protein 13.6) (ESP13.6) | Macaca mulatta | 123 | MKLLLLALPILVLLPQVIPAYGGEKKCWNRSGHCRK QCKDGEAVKETCKNHRACCVPSNEDHRRLPTTSPT PLSDSTPGIIDNILTIRFTTDYFEISSKKDMVEESEAG QGTQTSPPNVHHTS |
| 175 Beta-defensin 12 (BNDB-12) (BNBD-12) | Bos taurus | 38 | GPLSCGRNGGVCIPIRCPVPMRQIGTCFGRPVKCC RSW |
| 176 Beta-defensin 126 precursor (Epididymal secretory protein 13.2) (ESP13.2) | Macaca fascicularis | 123 | MKSLLFTLAVFMLLAQLVSGNLYVKRCLNDIGICKKT CKPEEVRSEHGWVMCGKRKACCVPADKRSAYPSF CVHSKTTKTSTVTARATATTATTATAATPLMISNGLI SLMTTMAATPVSPTT |
| 177 Beta-defensin 13 (BNDB-13) (BNBD-13) | Bos taurus | 42 | SGISGPLSCGRNGGVCIPIRCPVPMRQIGTCFGRPV KCCRSW |
| 178 Beta-defensin 2 | Macaca mulatta | 64 | MRVLYLLFSFLFIFLMPLPGVFGGIGDPVTCLKNGAI CHPVFCPRRYKQIGTCGLPGTKCCKKP |
| 179 Beta-defensin 2 (BNDB-2) (BNBD-2) | Bos taurus | 40 | VRNHVTCRINRGFCVPIRCPGRTRQIGTCFGPRIKC CRSW |
| 180 Beta-defensin 2 precursor (BD-2) (mBD-2) | Mus musculus | 71 | MRTLCSLLLICCLLFSYTTPAVGSLKSIGYEAELDHC HTNGGYCVRAICPPSARRPGSCFPEKNPCCKYMK |
| 181 Beta-defensin 2 precursor (BD-2) (RBD-2) | Rattus norvegicus | 63 | MRIHYLLFSFLLVLLSPLSAFTQSINNPITCLTKGGVC WGPCTGGFRQIGTCGLPRVRCCKKK |
| 182 Beta-defensin 2 precursor (BD-2) (sBD2) | Ovis aries | 64 | MRLHHLLLVLFFVVLSAGSGFTHGVTDSLSCRWKK GICVLTRCPGTMRQIGTCFGPPVKCCRLK |
| 183 Beta-defensin 3 precursor (BD-3) (mBD-3) | Mus musculus | 63 | MRIHYLLFAFLLVLLSPPAAFSKKINNPVSCLRKGGR CWNRCIGNTRQIGSCGVPFLKCCKRK |
| 184 Beta-defensin 3 precursor (BNDB-3) (BNBD-3) (Fragment) | Bos taurus | 57 | LALLFLVLSAGSGFTQGVRNHVTCRINRGFCVPIRC PGRTRQIGTCFGPRIKCCRSW |
| 185 Beta-defensin 4 precursor (BD-4) (mBD-4) | Mus musculus | 63 | MRIHYLLFTFLLVLLSPLAAFTQIINNPITCMTNGAIC WGPCPTAFRQIGNCGHFKVRCCKIR |
| 186 Beta-defensin 4 precursor (BNDB-4) (BNBD-4) | Bos taurus | 63 | MRLHHLLLAVLFLVLSAGSGFTQRVRNPQSCRWNM GVCIPFLCRVGMRQIGTCFGPRVPCCRR |
| 187 beta-defensin 4 variant | Mus musculus | 63 | MRIHYLLFTFLPVLLSPLAAFTQIINNPITCMTNGAIC WGPCPTAFRQIGNCGHFKVRCCKIR |
| 188 Beta-defensin 5 precursor (BNDB-5) (BNBD-5) | Bos taurus | 64 | MRLHHLLLVLLFLVLSAGSGFTQVVRNPQSCRWNM GVCIPISCPGNMRQIGTCFGPRVPCCRRW |
| 189 Beta-defensin 6 | Mus musculus | 63 | MKIHYLLFAFILVMLSPLAAFSQLINSPVTCMSYGGS CQRSCNGGFRLGGHCGHPKIRCCRRK |
| 190 Beta-defensin 6 (BNDB-6) (BNBD-6) | Bos taurus | 42 | QGVRNHVTCRIYGGFCVPIRCPGRTRQIGTCFGRP VKCCRRW |
| 191 Beta-Defensin 7 | Mus musculus | 37 | NSKRACYREGGECLQRCIGLFHKIGTCNFRFKCCKFQ |

TABLE 1-continued

| | | | |
|---|---|---|---|
| 192 Beta-defensin 7 (BNDB-7) (BNBD-7) | Bos taurus | 40 | QGVRNFVTCRINRGFCVPIRCPGHRRQIGTCLGPRI KCCR |
| 193 Beta-defensin 7 precursor | Mus musculus | 71 | MRIHYVLFAFLLVLLSPFAAFSQDINSKRACYREGGE CLQRCIGLFHKIGTCNFRFKCCKFQIPEKKTKIL |
| 194 Beta-Defensin 8 | Mus musculus | 35 | NEPVSCIRNGGICQYRCIGLRHKIGTCGSPFKCCK |
| 195 Beta-defensin 8 (Beta-defensin 6) | Mus musculus | 60 | MRIHYLLFTFLLVLLSPLAAFSQKINEPVSCIRNGGIC QYRCIGLRHKIGTCGSPFKCCK |
| 196 Beta-defensin 8 (BNDB-8) (BNBD-8) | Bos taurus | 38 | VRNFVTCRINRGFCVPIRCPGHRRQIGTCLGPQIKC CR |
| 197 Beta-defensin 9 precursor (BNDB-9) (BNBD-9) (Fragment) | Bos taurus | 55 | LALLFLVLSAGSGFTQGVRNFVTCRINRGFCVPIRC PGHRRQIGTCLAPQIKCCR |
| 198 Beta-defensin C7 precursor (BBD(C7)) (Fragment) | Bos taurus | 53 | LALLFLVLSAGSGISGPLSCRRKGGICILIRCPGPMR QIGTCFGRPVKCCRSW |
| 199 Beta-defensin prepropeptide | Gallus gallus | 80 | MRIVYLLIPFFLLFLQGAAGTATQCRIRGGFCRVGSC RFPHIAIGKCATFISCCGRAYEVDALNSVRTSPWLLA PGNNPH |
| 200 Beta-defensin prepropeptide | Meleagris gallopavo | 59 | MRIVYLLFPFFLLFLQSAAGTPIQCRIRGGFCRFGSC RFPHIAIAKCATFIPCCGSIWG |
| 201 Beta-defensin-1 | Equus caballus | 64 | MRILHFLLAFLIVFLLPVPGFTAGIETSFSCSQNGGF CISPKCLPGSKQIGTCILPGSKCCRKK |
| 202 Beta-defensin-12 (Hypothetical defensin-like structure containing protein) | Mus musculus | 85 | MKNLPSNMALSREVFYFGFALFFIVVELPSGSWAGL EYSQSFPGGEIAVCETCRLGRGKCRRTCIESEKIAG WCKLNFFCCRERI |
| 203 Beta-defensin-2 | Pan troglodytes | 64 | MRVLYLLFSFLFIFLMPLPGVFGGISDPVTCLKSGAI CHPVFCPRRYKQIGTCGLPGTKCCKKP |
| 204 beta-defensin-3 | Bos taurus | 42 | QGVRNHVTCRINRGFCVPIRCPGRTRQIGTCFGPRI KCCRSW |
| 205 Beta-defensin-3 (Fragment) | Pan troglodytes | 64 | MRIHYLLFALLFLFLVPVPGHGGIINTLQKYYCRVRG GRCAVLTCLPKEEQIGKCSTRGRKCCR |
| 206 beta-defensin-4 | Bos taurus | 41 | QRVRNPQSCRWNMGVCIPFLCRVGMRQIGTCFGP RVPCCRR |
| 207 beta-defensin-5 | Bos taurus | 40 | QVVRNPQSCRWNMGVCIPISCPGNMRQIGTCFGP RVPCCR |
| 208 beta-defensin-9 | Bos taurus | 40 | QGVRNFVTCRINRGFCVPIRCPGHRRQIGTCLGPQI KCCR |
| 209 Beta-defensin-like peptide 1 | Canis familiaris | 65 | MKAFLLTLAALVLLSQVTSGSAEKCWNLRGSCREK CIKNEKLYIFCTSGKLCCLKPKFQPNMLQR |
| 210 Beta-defensin-like peptide 2 | Canis familiaris | 69 | MKAFLLTLAALVLLSQVTSGSAEECWNLRGSCREK CIKNEKLYIFCTSGKLCCLKPKFQPNMLQRSVQF |
| 211 Beta-defensin-like peptide 3 | Canis familiaris | 99 | MKAFLLTLAALVLLSQVTSGSAEKCWNLRGSCREK CIKNEKLYIFCTSGKLCCLKPKFQPNMLQRNRKDNP KICLELQKILNIQSNLDKEEQSWKHCTS |
| 212 Big defensin | Tachypleus tridentatus | 79 | NPLIPAIYIGATVGPSVWAYLVALVGAAAVTAANIRR ASSDNHSCAGNRGWCRSKCFRHEYVDTYYSAVCG RYFCCRSR |

TABLE 1-continued

| | | | | |
|---|---|---|---|---|
| 213 | bombinin H Met-8 | Bombina variegata | 20 | IIGPVLGMVGSALGGLLKKI |
| 214 | Bombinin H1/H3 | Bombina variegata | 21 | IIGPVLGMVGSALGGLLKKIG |
| 215 | Bombinin H4 | Bombina variegata | 21 | LIGPVLGLVGSALGGLLKKIG |
| 216 | Bombinin H5 | Bombina variegata | 21 | IIGPVLGLVGSALGGLLKKIG |
| 217 | Bombinin-like peptide 2 (BLP-2) | Bombina orientalis | 27 | GIGSAILSAGKSALKGLAKGLAEHFAN |
| 218 | Bombinin-like peptide 4 (BLP-4) | Bombina orientalis | 25 | GIGAAILSAGKSIIKGLANGLAEHF |
| 219 | Bombinin-like peptide 7, BPL-7 precursor | Bombina orientalis | 144 | MNFKYIVAVSFLIASTYARSVKNDEQSLSQRDVLEEE ESLREIRGIGGALLSAGKSALKGLAKGLAEHFANGK RTAEEHEVMKRLEAVMRDLDSLDYPEEASEMETRS FNQEEIANLFTKKEKRILGPVLDLVGRALRGLLKKIG |
| 220 | Bombinin-like peptides 1 precursor [Contains: Acidic peptide 1; Bombinin-like peptide 1 (BLP-1); Octapeptide 1; Acidic peptide 2; Octapeptide 2; Acidic peptide 3; GH-1 peptide] | Bombina orientalis | 204 | MNFKYIVAVSILIASAYARSEENDIQSLSQRDVLEEE SLREIRGIGASILSAGKSALKGLAKGLAEHFANGKRT AEDHEVMKRLEAAIQSLSQRDVLEEESLREIRGIGA SILSAGKSALKGLAKGLAEHFANGKRTAEEHEVMKR LEAVMRDLDSLDYPEEASEMETRSFNQEEIANLYTK KEKRILGPILGLVSNALGGLLG |
| 221 | Bombinin-like peptides 1 precursor [Contains: Acidic peptide 1-1; Bombinin-like peptide 1 (BLP-1); Octapeptide 1; Acidic peptide 1-2; Bombinin H] | Bombina variegata | 137 | MNFKYIVAVSILIASAYARSEENDIQSLSQRDVLEEE SLREIRGIGGALLSAAKVGLKGLAKGLAEHFANGKR TAEEREVMKRLEAAMRDLDSFEHPEEASEKETRGF NQEEKEKRIIGPVLGLVGSALGGLLKKIG |
| 222 | Bombinin-like peptides 2 precursor [Contains: Acidic peptide 2-1; Bombinin-like peptide 2 (BLP-2); Octapeptide 2; Acidic peptide 2-2; Bombinin H2] | Bombina variegata | 137 | MNFKYIVAVSILIASAYARREENNIQSLSQRDVLEEE SLREIRGIGASILSAGKSALKGFAKGLAEHFANGKRT AEDHEMMKRLEAAVRDLDSLEHPEEASEKETRGFN QEEKEKRIIGPVLGLVGSALGGLLKKIG |
| 223 | Bombinin-like peptides 3 precursor [Contains: Acidic peptide 1; Bombinin-like peptide 3 (BLP-3); Octapeptide 1; Acidic peptide 2; Octapeptide 2; | Bombina orientalis | 200 | MNFKYIVAVSILIASAYARSEENDIQSLSQRDVLEEE SLREIRGIGAAILSAGKSALKGLAKGLAEHFGKRTAE DHEVMKRLEAAIHSLSQRDVLEEESLREIRGIGAAIL SAGKSALKGLAKGLAEHFGKRTAEEHEMMKRLEAV MRDLDSLDYPEEASEMETRSFNQEEIANLYTKKEKR ILGPILGLVSNALGGLLG |

TABLE 1-continued

| | | | |
|---|---|---|---|
| Acidic peptide 3; GH-1 peptide] | | | |
| 224 Bovine Neutrophil Beta-Defensin 12 | *Bos taurus* | 38 | APLSCGRNGGVCIPIRCPVPMRQIGTCFGRPVKCC RSW |
| 225 Brevinin-1 | *Rana brevipoda* | 24 | FLPVLAGIAAKVVPALFCKITKKC |
| 226 Brevinin-1BA | *Rana berlandieri* | 24 | FLPFIAGMAAKFLPKIFCAISKKC |
| 227 Brevinin-1BB | *Rana berlandieri* | 24 | FLPAIAGMAAKFLPKIFCAISKKC |
| 228 Brevinin-1BC | *Rana berlandieri* | 24 | FLPFIAGVAAKFLPKIFCAISKKC |
| 229 Brevinin-1BD | *Rana berlandieri* | 24 | FLPAIAGVAAKFLPKIFCAISKKC |
| 230 Brevinin-1BE | *Rana berlandieri* | 24 | FLPAIVGAAAKFLPKIFCVISKKC |
| 231 Brevinin-1BF | *Rana berlandieri* | 24 | FLPFIAGMAANFLPKIFCAISKKC |
| 232 Brevinin-1E precursor | *Rana esculenta* | 71 | MFTLKKSMLLLFFLGTINLSLCEEERDADEEERRDN PDESEVEVEKRFLPLLAGLAANFLPKIFCKITRKC |
| 233 Brevinin-1Ea | *Rana esculenta* | 24 | FLPAIFRMAAKVVPTIICSITKKC |
| 234 brevinin-1Eb | *Rana esculenta* | 24 | VIPFVASVAAEMMQHVYCAASRKC |
| 235 Brevinin-1Eb | *Rana esculenta* | 23 | VIPFVASVAAEMQHVYCAASRKC |
| 236 Brevinin-1LA | *Rana luteiventris* | 24 | FLPMLAGLAASMVPKLVCLITKKC |
| 237 Brevinin-1LB | *Rana luteiventris* | 24 | FLPMLAGLAASMVPKFVCLITKKC |
| 238 Brevinin-1PA | *Rana pipiens* | 24 | FLPIIAGVAAKVFPKIFCAISKKC |
| 239 Brevinin-1PB | *Rana pipiens* | 24 | FLPIIAGIAAKVFPKIFCAISKKC |
| 240 Brevinin-1PC | *Rana pipiens* | 24 | FLPIIASVAAKVFSKIFCAISKKC |
| 241 Brevinin-1PD | *Rana pipiens* | 24 | FLPIIASVAANVFSKIFCAISKKC |
| 242 Brevinin-1PE | *Rana pipiens* | 24 | FLPIIASVAAKVFPKIFCAISKKC |
| 243 Brevinin-1Sa | *Rana sphenocephala* | 24 | FLPAIVGAAGQFLPKIFCAISKKC |
| 244 Brevinin-1Sb | *Rana sphenocephala* | 24 | FLPAIVGAAGKFLPKIFCAISKKC |
| 245 Brevinin-1Sc | *Rana sphenocephala* | 24 | FFPIVAGVAGQVLKKIYCTISKKC |
| 246 Brevinin-1SY | *Rana sylvatica* | 24 | FLPVVAGLAAKVLPSIICAVTKKC |
| 247 Brevinin-1T | *Rana temporaria* | 20 | VNPIILGVLPKFVCLITKKC |

TABLE 1-continued

| | | | |
|---|---|---|---|
| 248 Brevinin-1TA | *Rana temporaria* | 17 | FITLLLRKFICSITKKC |
| 249 Brevinin-2 | *Rana brevipoda* | 33 | GLLDSLKGFAATAGKGVLQSLLSTASCKLAKTC |
| 250 Brevinin-2E | *Rana esculenta* | 33 | GIMDTLKNLAKTAGKGALQSLLNKASCKLSGQC |
| 251 Brevinin-2Ea | *Rana esculenta* | 33 | GILDTLKNLAISAAKGAAQGLVNKASCKLSGQC |
| 252 Brevinin-2Eb | *Rana esculenta* | 33 | GILDTLKNLAKTAGKGALQGLVKMASCKLSGQC |
| 253 Brevinin-2Ec | *Rana esculenta* | 34 | GILLDKLKNFAKTAGKGVLQSLLNTASCKLSGQC |
| 254 Brevinin-2Ed | *Rana esculenta* | 29 | GILDSLKNLAKNAGQILLNKASCKLSGQC |
| 255 Brevinin-2Ee | *Rana esculenta* | 29 | GIFDKLKNFAKGVAQSLLNKASCKLSGQC |
| 256 Brevinin-2Ef precursor | *Rana esculenta* | 74 | MFTMKKSLLLIFFLGTISLSLCQEERNADDDDGEMT EEEKRGIMDTLKNLAKTAGKGALQSLVKMASCKLS GQC |
| 257 Brevinin-2T | *Rana temporaria* | 33 | GLLSGLKKVGKHVAKNVAVSLMDSLKCKISGDC |
| 258 Brevinin-2Tb precursor | *Rana temporaria* | 74 | MFTMKKSLLLFFFLGTISLSLCQEERNADEDDGEMT EEEKRGILDTLKHLAKTAGKGALQSLLNHASCKLSG QC |
| 259 Brevinin-2TC | *Rana temporaria* | 29 | GLWETIKNFGKKFTLNILHKLKCKIGGGC |
| 260 Brevinin-2TD | *Rana temporaria* | 29 | GLWETIKNFGKKFTLNILHNLKCKIGGGC |
| 261 buforin I | *Bufo gargarizans* | 129 | MSGRGKQGGKVRAKAKTRSSRAGLQFPVGRVHRL LRKGNYAQRVGAGAPVYLAAVLEYLTAEILELAGNA ARDNKKTRIIPRHLQLAVRNDEELNKLLGGVTIAQG GVLPNIQAVLLPKTESSKPAKSK |
| 262 Buthinin | *Androctonus australis* | 34 | SIVPIRCRSNRDCRRFCGFRGGRCTYARQCLCGY |
| 263 Caeridin 1.1/1.2/1.3 | *Litoria chloris* | 13 | MGLLDGLLGTLGL |
| 264 Caeridin 1.1/1.2/1.3 | *Litoria xanthomera* | 12 | GLLDGLLGTLGL |
| 265 Caeridin 1.4 | *Litoria chloris* | 13 | MGLLDGLLGGLGL |
| 266 Caeridin 1.4 | *Litoria xanthomera* | 12 | GLLDGLLGGLGL |
| 267 Caerin 1.1 | *Litoria caerulea* | 26 | MGLLSVLGSVAKHVLPHVVPVIAEHL |
| 268 Caerin 1.1 | *Litoria splendida* | 25 | GLLSVLGSVAKHVLPHVVPVIAEHL |
| 269 Caerin 1.6 | *Litoria chloris* | 25 | MGLFSVLGAVAKHVLPHVVPVIAEK |
| 270 Caerin 1.6 | *Litoria xanthomera* | 24 | GLFSVLGAVAKHVLPHVVPVIAEK |
| 271 Caerin 1.7 | *Litoria chloris* | 25 | MGLFKVLGSVAKHLLPHVAPVIAEK |
| 272 Caerin 1.7 | *Litoria xanthomera* | 24 | GLFKVLGSVAKHLLPHVAPVIAEK |

TABLE 1-continued

| | | | |
|---|---|---|---|
| 273 | Caerulein | Litoria xanthomera | 10 | QQDYTGWMDF |
| 274 | cathelin related antimicrobial peptide | Mus musculus | 172 | MQFQRDVPSLWLWRSLSLLLLLGLGFSQTPSYRDA VLRAVDDFNQQSLDTNLYRLLDLDPEPQGDEDPDT PKSVRFRVKETVCGKAERQLPEQCAFKEQGVVKQ CMGAVTLNPAADSFDISCNEPGAQPFRFKKISRLAG LLRKGGEKIGEKLKKIGQKIKNFFQKLVPQPE |
| 275 | Cathelin-related antimicrobial peptide precursor (Cramp) (Cathelin-like protein) (CLP) | Mus musculus | 173 | MQFQRDVPSLWLWRSLSLLLLLGLGFSQTPSYRDA VLRAVDDFNQQSLDTNLYRLLDLDPEPQGDEDPDT PKSVRFRVKETVCGKAERQLPEQCAFKEQGVVKQ CMGAVTLNPAADSFDISCNEPGAQPFRFKKISRLAG LLRKGGEKIGEKLKKIGQKIKNFFQKLVPQPEQ |
| 276 | Cathelin-related peptide SC5 precursor 1 (Antibacterial peptide SMAP-29) (Myeloid antibacterial peptide SMAP-29) | Ovis aries | 160 | METQRASLSLGRCSLWLLLLGLALPSASAQVLSYRE AVLRAADQLNEKSSEANLYRLLELDPPPKQDDENS NIPKPVSFRVKETVCPRTSQQPAEQCDFKENGLLKE CVGTVTLDQVRNNFDITCAEPQSVRGLRRLGRKIAH GVKKYGPTVLRIIRIAG |
| 277 | Cathelin-related peptide SC5 precursor 2 (Antibacterial peptide SMAP-29) (Myeloid antibacterial peptide SMAP-29) | Ovis aries | 160 | METQRASLSLGRRSLWLLLLGLVLASASAQALSYRE AVLRAVDQLNEKSSEANLYRLLELDPPPKQDDENS NIPKPVSFRVKETVCPRTSQQPAEQCDFKENGLLKE CVGTVTLDQVGNNFDITCAEPQSVRGLRRLGRKIAH GVKKYGPTVLRIIRIAG |
| 278 | cathelin-related protein 1 precursor | Ovis aries | 160 | METQRAGLSLGRRSLWLLLLGLVLASASAQALSYR EAVLRAVDQLNEKSSEANLYRLLELDPPPKQDDEN SNIPKPVSFRVKETVCPRTSQQPAEQCDFKENGLLK ECVGTVTLDQVGNNFDITCAEPQSVRGLRRLGRKIA HGVKKYGPTVLRIIRIAG |
| 279 | cathelin-related protein 2 precursor | Ovis aries | 152 | SLGRCSLWLLLLGLALPSASAQVLSYREAVLRAADQ LNEKSSEANLYRLLELDPPPKQDDENSNIPKPVSFR VKETVCPRTSQQPAEQCDFKENGLLKECVGTVTLD QVRNNFDITCAEPQSVRGLRRLGRKIAHGVKKYGP TVLRIIRIAG |
| 280 | Cecropin (Antibacterial peptide CM-IV) | Bombyx mori | 35 | RWKIFKKIEKVGQNIRDGIVKAGPAVAVVGQAATI |
| 281 | Cecropin 1 precursor | Ceratitis capitata | 63 | MNFNKVFILVAIVIAIFAGQTEAGWLKKIGKKIERVGQ HTRDATIQTIAVAQQAANVAATARG |
| 282 | Cecropin 1 precursor | Drosophila virilis | 63 | MNFYKVFIFVALILAISLGQSEAGWLKKIGKKIERIGQ HTRDATIQGLGIAQQAANVAATARG |
| 283 | Cecropin 2 precursor | Ceratitis capitata | 63 | MNFNKVLVLLAVIFAVFAGQTEAGWLKKIGKKIERVG QHTRDATIQTIGVAQQAANVAATLKG |
| 284 | Cecropin 2 precursor | Drosophila virilis | 63 | MNFYKVFIFVALILAISLGQSEAGWLKKIGKKIERVGQ HTRDATIQGLGIAQQAANVAATARG |
| 285 | Cecropin 3 precursor | Drosophila virilis | 63 | MNFYKVFIFVALILAISLGQSEAGWLKKIGKKIERIGQ HTRDATIQGVGIAQQAANVAATARG |
| 286 | Cecropin A precursor | Aedes aegypti | 59 | MNFTKLFLLIAVAVLLLTGQSEAGGLKKLGKKLEGA GKRVFNAAEKALPVVAGAKALRK |
| 287 | Cecropin A precursor | Bombyx mori | 63 | MNFVRILSFVFALVLALGAVSAAPEPRWKLFKKIEKV GRNVRDGLIKAGPAIAVIGQAKSLGK |
| 288 | Cecropin A precursor | Trichoplusia ni | 62 | MNLVKILFCVFACLVFTVTAVPEPRWKFFKKIEKVG QNIRDGIIKAGPAVAVVGQAASITGK |

TABLE 1-continued

| | | | |
|---|---|---|---|
| 289 | Cecropin A precursor (Cecropin C) | Hyalophora cecropia | 64 | MNFSRIFFFVFACLTALAMVNAAPEPKWKLFKKIEKV GQNIRDGIIKAGPAVAVVGQATQIAKG |
| 290 | Cecropin A precursor (Fragment) | Spodoptera litura | 57 | IFFFVFACLLALSAVSAAPEPRWKVFKKIEKVGRNVR DGIIKAGPAIGVLGQAKALG |
| 291 | Cecropin A1/A2 precursor | Drosophila melanogaster | 63 | MNFYNIFVFVALILAITIGQSEAGWLKKIGKKIERVGQ HTRDATIQGLGIAQQAANVAATARG |
| 292 | Cecropin B | Antheraea pernyi | 35 | KWKIFKKIEKVGRNIRNGIIKAGPAVAVLGEAKAL |
| 293 | Cecropin B precursor | Drosophila melanogaster | 63 | MNFNKIFVFVALILAISLGNSEAGWLRKLGKKIERIGQ HTRDASIQVLGIAQQAANVAATARG |
| 294 | Cecropin B precursor (Fragment) | Spodoptera litura | 58 | ILSFVFACLLALSAVSAAPEPRWKVFKKIEKMGRNIR DGIVKAGPAIEVLGSAKALGK |
| 295 | Cecropin B precursor (Immune protein P9) | Hyalophora cecropia | 62 | MNFSRIFFFVFALVLALSTVSAAPEPKWKVFKKIEKM GRNIRNGIVKAGPAIAVLGEAKALG |
| 296 | Cecropin B precursor (Lepidopteran A and B) | Bombyx mori | 63 | MNFAKILSFVFALVLALSMTSAAPEPRWKIFKKIEKM GRNIRDGIVKAGPAIEVLGSAKAIGK |
| 297 | Cecropin C precursor | Drosophila erecta | 63 | MNFNKIFVFVALILAISLGQSEAGWLKKLGKRIERIGQ HTRDATIQGLGIAQQAANVAATARG |
| 298 | Cecropin C precursor | Drosophila mauritiana | 63 | MNFYKIFVFVALILAISIGQSEAGWLKKLGKRIERIGQ HTRDATIQGLGIAQQAANVAATARG |
| 299 | Cecropin D precursor | Bombyx mori | 61 | MKFSKIFVFVFAIVFATASVSAAPGNFFKDLEKMGQ RVRDAVISAAPAVDTLAKAKALGQG |
| 300 | Cecropin D precursor | Hyalophora cecropia | 62 | MNFTKILFFVVACVFAMRTVSAAPWNPFKELEKVG QRVRDAVISAGPAVATVAQATALAKGK |
| 301 | Cecropin P1 | Sus scrofa | 31 | SWLSKTAKKLENSAKKRISEGIAIAIQGGPR |
| 302 | ceratotoxin A | Ceratitis capitata | 29 | SIGSALKKALPVAKKIGKIALPIAKAALP |
| 303 | Ceratotoxin A precursor 1 | Ceratitis capitata | 71 | MANLKAVFLICIVAFIALQCVVAEPAAEDSVVVKRSIG SALKKALPVAKKIGKIALPIAKAALPVAAGLVG |
| 304 | Ceratotoxin A precursor 2 | Ceratitis capitata | 71 | MANLKAVFLICIVAFIAFQCVVAEPAAEDSIVVKRSIG SALKKALPVAKKIGKIALPIAKAALPVAAGLVG |
| 305 | Ceratotoxin B | Ceratitis capitata | 29 | SIGSAFKKALPVAKKIGKAALPIAKAALP |
| 306 | Ceratotoxin C precursor | Ceratitis capitata | 67 | MANIKAVFLICIVAFIAFHCVVAEPTAEDSVVVKRSLG GVISGAKKVAKVAIPIGKAVLPVVAKLVG |
| 307 | Ceratotoxin D precursor | Ceratitis capitata | 71 | MANLKAVFLICILAFIAFHCVVGAPTAEDSIVVKRSIG TAVKKAVPIAKKVGKVAIPIAKAVLSVVGQLVG |
| 308 | Chlamysin precursor | Chlamys islandica | 137 | MMYFVLFCLLAAGTTYGSHNFATGIVPHSCLECICK TESGCRAIGCKFDVYSDSCGYFQLKQAYWEDCGR PGGSLTSCADDIHCSSQCVQHYMSRYIGHTSCSRT CESYARLHNGGPHGCEHGSTLGYWGHVQGHGC |
| 309 | Chromogranin A precursor (CgA) (Pituitary secretory protein I) (SP-I) [Contains: Vasostatin-1; Chromostatin; Chromacin; Pancreastatin; | Bos taurus | 449 | MRSAAVLALLLCAGQVIALPVNSPMNKGDTEVMKCI VEVISDTLSKPSPMPVSKECFETLRGDERILSILRHQ NLLKELQDLALQGAKERTHQQKKHSSYEDELSEVL EKPNDQAEPKEVTEEVSSKDAAEKRDDFKEVEKSD EDSDGDRPQASPGLGPGPKVEEDNQAPGEEEEAP SNAHPLASLPSPKYPGPQAKEDSEGPSQGPASREK GLSAEQGRQTEREEEEEKWEEAEAREKAVPEEES PPTAAFKPPPSLGNKETQRAAPGWPEDGAGKMGA EEAKPPEGKGEWAHSRQEEEEMARAPQVLFRGGK SGEPEQEEQLSKEWEDAKRWSKMDQLAKELTAEK |

TABLE 1-continued

| | | | |
|---|---|---|---|
| WE-14; Catestatin] | | | RLEGEEEEEEDPDRSMRLSFRARGYGFRGPGLQL RRGWRPNSREDSVEAGLPLQVRGYPEEKKEEEGS ANRRPEDQELESLSAIEAELEKVAHQLEELRRG |
| 310 chromogranin B | Bos taurus | 170 | MPVDIRNHNEEVVTHLRDPADTSEAPGLSAGEPPG SQVAKEAKTRYSKSEGQNREEEMVKYQKRERGEV GSEERLSEGPQRNQTPAKKSSQEGNPPLEEESHV GTGALEEGAERLPGELRNYLDYGEEKGEESAEFPD FYDSEEQMSPQHTAEDLELQKIAEKFSGTRRG |
| 311 Chrysophsin-1 | Pagrus major | 25 | FFGWLIKGAIHAGKAIHGLIHRRRH |
| 312 Chrysophsin-2 | Pagrus major | 25 | FFGWLIRGAIHAGKAIHGLIHRRRH |
| 313 Chrysophsin-3 | Pagrus major | 20 | FIGLLISAGKAIHDLIRRRH |
| 314 Cicadin (Fragment) | Cicada flammata | 55 | NEYHGFVDKANNENKRKKQQGRDDFVVKPNNFAN RRRKDDYNENYYDDVDAADVV |
| 315 Citropin 1.1 [Contains: Citropin 1.1.1; Citropin 1.1.2] | Litoria citropa | 16 | GLFDVIKKVASVIGGL |
| 316 Citropin 1.1.3 | Litoria citropa | 18 | GLFDVIKKVASVIGLASP |
| 317 Citropin 1.1.4 | Litoria citropa | 18 | GLFDVIKKVASVIGLASQ |
| 318 Citropin 1.2 [Contains: Citropin 1.2.1; Citropin 1.2.2; Citropin 1.2.3] | Litoria citropa | 16 | GLFDIIKKVASVVGGL |
| 319 Citropin 1.2.4 | Litoria citropa | 18 | GLFDIIKKVASVVGLASP |
| 320 Citropin 1.2.5 | Litoria citropa | 18 | GLFDIIKKVASVVGLASQ |
| 321 Citropin 1.3 | Litoria citropa | 16 | GLFDIIKKVASVIGGL |
| 322 Citropin 2.1.3 [Contains: Citropin 2.1.2; Citropin 2.1.1; Citropin 2.1] | Litoria citropa | 26 | GLIGSIGKALGGLLVDVLKPKLQAAS |
| 323 Citropin 3.1.2 [Contains: Citropin 3.1.1; Citropin 3.1] | Litoria citropa | 24 | DLFQVIKEKLKELTGGVIEGIQGV |
| 324 Clavanin A precursor | Styela clava | 80 | MKTTILILLILGLGINAKSLEERKSEEEKVFQFLGKIIH HVGNFVHGFSHVFGDDQQDNGKFYGHYAEDNGKH WYDTGDQ |
| 325 Clavanin B | Styela clava | 23 | VFQFLGRIIHHVGNFVHGFSHVF |
| 326 Clavanin C precursor | Styela clava | 80 | MKTTILILLILGLGINAKSLEERKSEEEKVFHLLGKIIH HVGNFVYGFSHVFGDDQQDNGKFYGHYAEDNGKH WYDTGDQ |
| 327 Clavanin D precursor | Styela clava | 80 | MKTTILILLILGLGINAKSLEERKSEEEKAFKLLGRIIH HVGNFVYGFSHVFGDDQQDNGKFYGHYAEDNGKH WYDTGDQ |
| 328 Clavanin E precursor | Styela clava | 80 | MKTTILILLILGLGINAKSLEERKSEEEKLFKLLGKIIHH VGNFVHGFSHVFGDDQQDNGKFYGYYAEDNGKH WYDTGDQ |

TABLE 1-continued

| | | | |
|---|---|---|---|
| 329 Coleoptericin | *Zophobas atratus* | 74 | SLQGGAPNFPQPSQQNGGWQVSPDLGRDDKGNT RGQIEIQNKGKDHDFNAGWGKVIRGPNKAKPTWHV GGTYRR |
| 330 Corticostatin I precursor (CS-I) (Neutrophil antibiotic peptide NP-3A) (Microbicidal peptide NP-3A) (Antiadrenocorticotropin peptide I) | *Oryctolagus cuniculus* | 93 | MRTLILLAAILLAALQAQAELFSVNVDEVLDQQQPGS DQDLVIHLTGEESSALQVPDTKGICACRRRFCPNSE RFSGYCRVNGARYVRCCSRR |
| 331 Corticostatin II (CS-II) (Neutrophil antibiotic peptide NP-3B) (Microbicidal peptide NP-3B) (Antiadrenocorticotropin peptide II) | *Oryctolagus cuniculus* | 34 | GRCVCRKQLLCSYRERRIGDCKIRGVRFPFCCPR |
| 332 Corticostatin III precursor (CS-III) (Macrophage antibiotic peptide MCP-1) (NP-1) (Antiadrenocorticotropin peptide III) | *Oryctolagus cuniculus* | 95 | MRTLALLAAILLVALQAQAEHVSVSIDEVVDQQPPQ AEDQDVAIYVKEHESSALEALGVKAGVVCACRRAL CLPRERRAGFCRIRGRIHPLCCRR |
| 333 Corticostatin IV precursor (CS-IV) (Macrophage antibiotic peptide MCP-2) (NP-2) (Antiadrenocorticotropin peptide IV | *Oryctolagus cuniculus* | 95 | MRTLALLAAILLVALQAQAEHISVSIDEVVDQQPPQA EDQDVAIYVKEHESSALEALGVKAGVVCACRRALCL PLERRAGFCRIRGRIHPLCCRR |
| 334 Corticostatin VI (CS-VI) (Neutrophil antibiotic peptide NP-6) | *Oryctolagus cuniculus* | 34 | GICACRRRFCLNFEQFSGYCRVNGARYVRCCSRR |
| 335 Corticostatin-related peptide RK-1 | *Oryctolagus cuniculus* | 32 | MPCSCKKYCDPWEVIDGSCGLFNSKYICCREK |
| 336 Crabrolin | *Vespa crabro* | 13 | FLPLILRKIVTAL |
| 337 cryptdin | *Mus musculus* | 23 | CKRRERMNGTCRKGHLLYTLCCR |
| 338 cryptdin 12 | *Mus musculus* | 35 | LRDLVCYCRARGCKGRERMNGTCRKGHLLYMLCCR |
| 339 Cryptdin-1 (CR1) | *Mus musculus* | 35 | LRDLVCYCRTRGCKRRERMNXTCRKGHLMYTLCCX |
| 340 Cryptdin-1 precursor (DEFCR) | *Mus musculus* | 93 | MKKLVLLFALVLLGFQVQADSIQNTDEETKTEEQPG EEDQAVSVSFGDPEGTSLQEESLRDLVCYCRSRGC KGRERMNGTCRKGHLLYTLCCR |
| 341 cryptdin-10 | *Mus musculus* | 35 | LRDLVCYCRKRGCKGRERMNGTCRKGHLLYTLCCR |

TABLE 1-continued

| | | | | |
|---|---|---|---|---|
| 342 | Cryptdin-10 precursor (Fragment) | Mus musculus | 92 | KTLVLLSALVLLAFQVQADPIQNTDEETKTEEQPGE DDQAVSVSFGDPEGSSLQEESLRDLVCYCRKRGC KGRERMNGTCRKGHLLYTMCCR |
| 343 | cryptdin-11 | Mus musculus | 35 | LRDLVCYCRSRGCKGRERMNGTCRKGHLLYMLCCR |
| 344 | Cryptdin-11 precursor (Fragment) | Mus musculus | 85 | ALVLLAFQVQADPIQNTDEETKTEEQPGEEDQAVSV SFGDPEGTSLQEESLRDLVCYCRSRGCKGRERMN GTCRKGHLLYMLCCR |
| 345 | cryptdin-13 | Mus musculus | 35 | LRDLVCYCRKRGCKRREHMNGTCRRGHLMYTLCCR |
| 346 | Cryptdin-13 precursor | Mus musculus | 93 | MKTLVLLSALVLLAFQVQADPIQNTDEETKTEEQPG EEDQAVSVSFGDPEGTSLQEESLRDLVCYCRKRGC KRREHMNGTCRRGHLMYTLCCR |
| 347 | Cryptdin-14 precursor (Fragment) | Mus musculus | 85 | ALVLLAFQVQADPIQNTDEETKTEEQPGEDDQAVSV SFGDPEGSSLQEESLRDLVCYCRTRGCKRRERMN GTCRKGHLMHTLCCR |
| 348 | cryptdin-15 | Mus musculus | 35 | LRDLVCYCRKRGCKRREHINGTCRKGHLLYMLCCR |
| 349 | Cryptdin-15 precursor | Mus musculus | 93 | MKTLVLLSALVLLAFQVQADPIQNTDEETKTEEQPG EDDQAVSVSFGDPEGSSLQEESLRDLVCYCRKRG CKRREHINGTCRKGHLLYMLCCR |
| 350 | cryptdin-16 | Mus musculus | 35 | LRDLVCYCRSRGCKGRERMNGTCRKGHLMYTLCCR |
| 351 | Cryptdin-16 precursor | Mus musculus | 93 | MKTLILLSALVLLAFQVQADPIQNTDEETKTEEQPGE EDQAVSVSFGDPEGTSLQEESLRDLVCYCRSRGCK GRERMNGTCRKGHLMYTLCCR |
| 352 | Cryptdin-17 precursor (CRYP17) (Fragment) | Mus musculus | 82 | LLAFQVQADPIQNTDEETKTEEQPGEEDQAVSVSF GDPEGTSLQEESLRDLVCYCRKRGCKRREHMNGT CRKGHLLYTLCCR |
| 353 | Cryptdin-2 (CR2) | Mus musculus | 35 | LRDLVCYCRARGXKGRERMNGTXRKGHLLYMXXXX |
| 354 | Cryptdin-2 precursor | Mus musculus | 93 | MKPLVLLSALVLLSFQVQADPIQNTDEETKTEEQSG EEDQAVSVSFGDREGASLQEESLRDLVCYCRTRGC KRRERMNGTCRKGHLMYTLCCR |
| 355 | Cryptdin-3 precursor | Mus musculus | 93 | MKTLVLLSALVLLAFQVQADPIQNTDEETKTEEQPG EEDQAVSVSFGDPEGSSLQEESLRDLVCYCRKRG CKRRERMNGTCRKGHLMYTLCCR |
| 356 | cryptdin-4 | Mus musculus | 34 | LRGLLCYCRKGHCKRGERVRGTCGIRFLYCCPRR |
| 357 | Cryptdin-4 precursor | Mus musculus | 92 | MKTLVLLSALVLLAFQVQADPIQNTDEETKTEEQPG EEDQAVSISFGGQEGSALHEKSLRGLLCYCRKGHC KRGERVRGTCGIRFLYCCPRR |
| 358 | Cryptdin-5 precursor | Mus musculus | 93 | MKTFVLLSALVLLAFQVQADPIHKTDEETNTEEQPG EEDQAVSISFGGQEGSALHEELSKKLICYCRIRGCK RRERVFGTCRNLFLTFVFCCS |
| 359 | Cryptdin-6/12 precursor | Mus musculus | 93 | MKTLILLSALVLLAFQVQADPIQNTDEETKTEEQPGE EDQAVSVSFGDPEGTSLQEESLRDLVCYCRARGCK GRERMNGTCRKGHLLYMLCCR |
| 360 | cryptdin-7 | Mus musculus | 35 | LRDLVCYCRTRGCKRREHMNGTCRKGHLMYTLCCR |
| 361 | Cryptdin-7 precursor | Mus musculus | 93 | MKTLILLSALVLLAFQVQADPIQNTDEETKTEEQPGE DDQAVSVSFGDPEGSSLQEESLRDLVCYCRTRGCK RREHMNGTCRKGHLMYTLCCR |
| 362 | cryptdin-8 | Mus musculus | 35 | LRDLVCYCRKRGCKRREHMNGTCRKGHLMYTLCCR |

TABLE 1-continued

| 363 | Cryptdin-8 precursor (Fragment) | Mus musculus | 81 | LAFQVQADPIQNTDEETKTEEQPGEDDQAVSVSFG DPEGSSLQEESLRDLVCYCRKRGCKRREHMNGTC RKGHLMYTLCCR |
| --- | --- | --- | --- | --- |
| 364 | cryptdin-9 | Mus musculus | 35 | LRDLVCYCRKRGCKRREHMNGTCRKGHLLYMLCCR |
| 365 | Cryptdin-9 precursor | Mus musculus | 93 | MKTLVLLSALVLLAFQVQADPIQNTDEETKTEEQPG EEDQAVSVSFGDPEGSSLQEESLRDLVCYCRKRGC KRREHMNGTCRKGHLLYMLCCR |
| 366 | Cryptdin-related protein 1C precursor (CRS1C) | Mus musculus | 116 | MKTLVLLSALVLPCFQVQADPIQNTDEETKTEEQPE EEDQAVSVSFGGTEGSALQDVAQRRFPWCRKCRV CQKCQVCQKCPVCPTCPQCPKQPLCEERQNKTAIT TQAPNTQHKGC |
| 367 | Cryptdin-related protein 4C-1 precursor (CRS4C) | Mus musculus | 91 | MKKLVLLFALVLLAFQVQADSIQNTDEETKTEEQPG EKDQAVSVSFGDPQGSALQDAALGWGRRCPQCPR CPSCPSCPRCPRCPRCKCNPK |
| 368 | Cryptdin-related protein 4C-2 precursor (CRS4C) | Mus musculus | 91 | MKKLVLLFALVLLAFQVQADSIQNTDEETKTEEQQG EEDQAVSVSFGDPQGSGLQDAALGWGRRCPRCPP CPRCSWCPRCPTCPRCNCNPK |
| 369 | Cryptdin-related protein 4C-4 precursor (CRS4C) | Mus musculus | 91 | MKKLVLLSAFVLLAFQVQADSIQNTDEETKTEEQPG EENQAMSVSFGDPEGSALQDAAVGMARPCPPCPS CPSCPWCPMCPRCPSCKCNPK |
| 370 | Cryptdin-related protein 4C-5 precursor (CRS4C) | Mus musculus | 91 | MKKLVLLSAFVLLAFQVQADSIQNTDEEIKTEEQPGE ENQAVSISFGDPEGYALQDAAIRRARRCPPCPSCLS CPWCPRCLRCPMCKCNPK |
| 371 | Cyclic dodecapeptide precursor (Bactenecin 1) | Bos taurus | 155 | METPRASLSLGRWSLWLLLLGLALPSASAQALSYR EAVLRAVDQLNEQSSEPNIYRLLELDQPPQDDEDP DSPKRVSFRVKETVCSRTTQQPPEQCDFKENGLLK RCEGTVTLDQVRGNFDITCNNHQSIRITKQPWAPPQ AARLCRIVVIRVCR |
| 372 | Cyclic dodecapeptide precursor (Bactenecin 1) | Ovis aries | 155 | METQRASLSLGRCSLWLLLLGLALPSASAQVLSYRE AVLRAVDQLNEQSSEPNIYRLLELDQPPQDDEDPD SPKRVSFRVKETVCPRTTQQPPEQCDFKENGLLKR CEGTVTLDQVRGNFDITCNNHQSIRITKQPWAPPQA ARICRIIFLRVCR |
| 373 | DEFB1-like protein | Cercopithecus aethiops | 68 | MRTSYLLLFTLCLLLSEMASGDNFLTGLGHRSDHYN CVRSGGQCLYSACPIYTKIQGTCYHGKAKCCK |
| 374 | DEFB1-like protein | Cercopithecus erythrogaster | 68 | MRTSYLLLFTLCLLLSEMASGDNFLTGLGHRSDHYI CVRSGGQCLYSACPIYTKIQGTCYHGKAKCCK |
| 375 | DEFB1-like protein | Gorilla gorilla | 68 | MRTSYLLLFTLCLLLSEIASGGNFLTGLGHRSDHYN CVSSGGQCLYSACPIFTKIQGTCYGGKAKCCK |
| 376 | DEFB1-like protein | Hylobates concolor | 68 | MRTSYLLLFTLCLLLSEMASGDNFLTGLGHRSDHYN CVRSGGQCLYSACPIYTKIQGTCYQGKAKCCK |
| 377 | DEFB1-like protein | Pan troglodytes | 68 | MRTSYLLLFTLCLLLSEMASGGNFLTGLGHRSDHYN CVSSGGQCLYSACPIFTKIQGTCYGGKAKCCK |
| 378 | DEFB1-like protein | Presbytis obscura | 68 | MRTSYLLLFTLCLLMSEMASGDNFLTGLGHRSDHY NCVRSGGQCLYSACPIYTKIQGTCYHGKAKCCK |
| 379 | DEFB1-like protein | Saguinus oedipus | 68 | MRTSYLLLFILCLVLCDMDSGDTFLTGLGHRSDHYN CVKGGGQCLYSACPIYTKVQGTCYGGKAKCCK |
| 380 | DEFB36 (Fragment) | Mus musculus | 43 | MKLLLLTLAALLLVSQLTPGDAQKCWNLHGKCRHR CSRKESVY |
| 381 | Defensin | Aeshna cyanea | 38 | GFGCPLDQMQCHRHCQTITGRSGGYCSGPLKLTC TCYR |
| 382 | Defensin | Allomyrina dichotoma | 43 | VTCDLLSFEAKGFAANHSLCAAHCLAIGRRGGSCE RGVCICRR |

TABLE 1-continued

| 383 | Defensin | Anopheles gambiae | 102 | MKCATIVCTIAVVLAATLLNGSVQAAPQEEAALSGG ANLNTLLDELPEETHHAALENYRAKRATCDLASGFG VGNNLCAAHCIARRYRGGYCNSKAVCVCRN |
| --- | --- | --- | --- | --- |
| 384 | defensin | Anopheles gambiae | 131 | NSRVNGATPAKLKLVLLCLPRASSSPQLIMKCATIVC TIAVVLAATLLNGSVQAAPQEEAALSGGANLNTLLD ELPEETHHAALENYRAKRATCDLASGFGVGSSLCA AHCIARRYRGGYCNSKAVCVCRN |
| 385 | Defensin | Bombus pascuorum | 51 | VTCDLLSIKGVAEHSACAANCLSMGKAGGRCENGI CLCRKTTFKELWDKRF |
| 386 | Defensin | Branchiostoma belcheri | 117 | MEKKTAYCLLFLVLLVPYTALGAVLKRAPAKKEKRA VPLAVPLVYWGASVSPAVWNWLLVTFGAAAVAAAA VTVSDNDSHSCANNRGWCRSRCFSHEYIDSWHSD VCGSYDCCRPRY |
| 387 | Defensin | Drosophila melanogaster | 92 | MKFFVLVAIAFALLACMAQAQPVSDVDPIPEDHVLV HEDAHQEVLQHSRQKRATCDLLSKWNWNHTACAG HCIAKGFKGGYCNDKAVCVCRN |
| 388 | Defensin | Drosophila melanogaster | 92 | MKFFVLVAIAFALLACMAQAQPVSDVDPIPEDHVLV HEDANQEVLQHSRQKRATCDLLSKWNWNHTACAG HCIAKGFKGGYCNDKAVCVCRN |
| 389 | Defensin | Drosophila melanogaster | 92 | MKFFVLVAIAFALLTCMAQAQPVSDVDPIPEDHVLV HEDAHQEVLQHSRQKRATCDLLSKWNWNHTACAG HCIAKGFKGGYCNDKAVCVCRN |
| 390 | Defensin | Drosophila melanogaster | 92 | MKFFVPVAIAFALLACVAQAQPVSDVDPIPEDHVLV HDDAHQEVLQHSRQKRATCDLLSKWNWNHTACAG HCIAKGFKGGYCNDKAVCVCRN |
| 391 | Defensin | Drosophila simulans | 92 | MKFFVLVAIAFALLACMAQAQPVSDVDPIPEDHALV HEDAHQEVVQHSRQKRATCDLLSKWNWNHTACAG HCIAKGFKGGYCNDKAVCVCRN |
| 392 | Defensin | Mamestra brassicae | 98 | MLCLADIRIVASCSAAIKSGYGQQPWLAHVAGPYAN SLFDDVPADSYHAAVEYLRLIPASCYLLDGYAAGRD DGRAHCIAPRNRRLYCASYQVCVCRY |
| 393 | Defensin | Musca domestica | 92 | MKYFTMFAFFFVAVCYISQSSASPAPKEEANFVHGA DALKQLEPELHGRYKRATCDLLSGTGVGHSACAAH CLLRGNRGGYCNGKGVCVCRN |
| 394 | Defensin | Ornithodoros moubata | 73 | MNKLFIVALVLALAVATMAHEVHDDIEEPSVPRVRR GFGCPFNQYECHAHCSGVPGYKGGYCKGLFKQTC NCY |
| 395 | Defensin | Ornithodoros moubata | 73 | MNKLFIVALVLALAVATMAHEVYDDVEEPSVPRVRR GYGCPFNQYQCHSHCSGIRGYKGGYCKGLFKQTC NCY |
| 396 | Defensin | Palomena prasina | 43 | ATCDALSFSSKWLTVNHSACAIHCLTKGYKGGRCV NTICNCRN |
| 397 | Defensin | Phlebotomus duboscqi | 40 | ATCDLLSAFGVGHAACAAHCIGHGYRGGYCNSKAV CTCRR |
| 398 | Defensin | Pyrocoelia rufa | 55 | MKLSVFVLVAVMLVLLCCAMQTEARRRCRSCVPFC GSNERMISTCFSGGVVCCPR |
| 399 | Defensin | Pyrrhocoris apterus | 43 | ATCDILSFQSQWVTPNHAGCALHCVIKGYKGGQCKI TVCHCRR |
| 400 | Defensin (Fragment) | Aedes albopictus | 57 | DELPEETYQAAVENYRRKRATCDLLSGFGVGDSAC AAHCIARRNRGGYCNAKTVCVC |
| 401 | Defensin (Fragment) | Apis mellifera | 57 | FEPLEHFENEERADRHRRVTCDLLSFKGQVNDSAC AANCHSLGKAGGHCEKGVCICR |
| 402 | Defensin 1 (Fragment) | Stomoxys calcitrans | 39 | ATCDLLSGMGVNHSACAAHCVLRGNRGGYCNSKA VCVCR |
| 403 | Defensin 1 precursor | Acalolepta luxuriosa | 83 | MKFFITFTFVLSLVVLTVYSAPREFAEPEEQDEGHF RVKRFTCDVLSVEAKGVKLNHAACGIHCLFRRRTG GYCNKKRVCICR |

TABLE 1-continued

| | | | |
|---|---|---|---|
| 404 Defensin 1 precursor | Stomoxys calcitrans | 79 | MKFLNVVAIALLVVACLAVYSNAAPHEGVKEVAAAK PMGITCDLLSLWKVGHAACAAHCLVLGDVGGYCTK EGLCVCKE |
| 405 Defensin 1A precursor | Stomoxys calcitrans | 79 | MKFLNVVAIALLVVACLSVYSNAAPHEGVKEVAAAK PMGITCDLLSLWKVGHAACAAHCLVLGNVGGYCTK EGLCVCKE |
| 406 Defensin 2 precursor | Stomoxys calcitrans | 97 | MKFFSLFPVIVVVVACLTMRANAAPSAGNEVDHHP DYVDGVEALRQLEPELHGRYKRATCDLLSMWNVN HSACAAHCLLLGKSGGRCNDDAVCVCRK |
| 407 Defensin 2A precursor | Stomoxys calcitrans | 97 | MKFFSLFPVILVVVACLTMRANAAPSAGDEVDHHPD YVDGVEALRQLEPELHGRYKRATCDLLSMWNVNH SACAAHCLLLGKSGGRCNDDAVCVCRK |
| 408 Defensin 5 precursor (RD-5) (Enteric defensin) | Rattus norvegicus | 93 | MKKLVLLSALVLLALQVEAEPTPKTDEGTKTDEQPG KEDQVVSVSIEGQGDPAFQDAVLRDLKCFCRRKSC NWGEGIMGICKKRYGSPILCCR |
| 409 Defensin A | Aedes aegypti | 98 | MQSLTVICFLALCTGAITSAYPQEPVLADEARPFANS LFDELPEETYQAAVENFRLKRATCDLLSGFGVGDSA CAAHCIARGNRGGYCNSKKVCVCRN |
| 410 Defensin A | Mytilus edulis | 37 | GFGCPNDYPCHRHCKSIPGRXGGYCGGXHRLRCT CYR |
| 411 Defensin A | Ornithodoros moubata | 73 | MNKLFIVALVVALAVATMAQEVHNDVEEQSVPRVR RGYGCPFNQYQCHSHCSGIRGYKGGYCKGTFKQT CKCY |
| 412 Defensin A | Rhodnius prolixus | 94 | MKCILSLVTLFLVAVLVHSHPAEWNTHQQLDDALWE PAGEVTEEHVARLKRATCDLFSFRSKWVTPNHAAC AAHCLLRGNRGGRCKGTICHCRK |
| 413 defensin A isoform 2; AaDefA2 | Aedes aegypti | 37 | MKSLTVICFLALCTGAITSAYPQEPVLADEARPFANS |
| 414 defensin A isoform 3; AaDefA3 | Aedes aegypti | 37 | MQSLTVICFLALCTGAITSAYPQEPVLADEARPFANS |
| 415 defensin A isoform 4; AaDefA4 | Aedes aegypti | 37 | MQPLTVICFLALCTGAITSAYPQEPVLADEARPFANS |
| 416 Defensin A precursor (AADEF) | Aedes aegypti | 98 | MKSITVICFLALCTVAITSAYPQEPVLADEARPFANSL FDELPEETYQAAVENFRLKRATCDLLSGFGVGDSA CAAHCIARGNRGGYCNSKKVCVCRN |
| 417 defensin A protein isoform 5 | Aedes aegypti | 98 | MQSITVICFLALCTGAITSAYPQEPVLADEARPFANS LFDELPEETYQAAVENFRLKRATCDLLSGFGVGDSA CAAHCIARGNRGGYCNSKKVCVCRN |
| 418 defensin alpha-1 | Macaca mulatta | 30 | ACYCRIPACLAGERRYGTCFYLGRVWAFCC |
| 419 defensin alpha-3 | Macaca mulatta | 30 | ACYCRIPACLAGERRYGTCFYRRRVWAFCC |
| 420 defensin alpha-4 | Macaca mulatta | 33 | RRTCRCRFGRCFRRESYSGSCNINGRIFSLCCR |
| 421 defensin alpha-5 | Macaca mulatta | 32 | RTCRCRFGRCFRRESYSGSCNINGRIFSLCCR |
| 422 defensin alpha-6 | Macaca mulatta | 33 | RRTCRCRFGRCFRRESYSGSCNINGRISSLCCR |
| 423 defensin alpha-7 | Macaca mulatta | 32 | RTCRCRFGRCFRRESYSGSCNINGRISSLCCR |
| 424 Defensin B | Aedes aegypti | 40 | ATCDLLSGFGVGDSACAAHCIARGNRGGYCNSQKV CVCRN |

TABLE 1-continued

| | | | |
|---|---|---|---|
| 425 Defensin B | Ornithodoros moubata | 73 | MNKLFIVALVVALAVATMAQEVHDDVEEQSVPRVR RGYGCPFNQYQCHSHCRGIRGYKGGYCTGRFKQT CKCY |
| 426 Defensin B | Rhodnius prolixus | 94 | MKCILSLVTLFLVAVLVHSHPAEWNTQQELDDALWE PAGEVTEEHVARLKRATCDLLSFSSKWVTPNHAGC AAHCLLRGNRGGHCKGTICHCRK |
| 427 Defensin B (Fragment) | Mytilus edulis | 35 | GFGCPNDYPCHRHCKSIPGRYGGYCGGXHRLRCTC |
| 428 defensin beta 14; beta defensin 14 | Mus musculus | 67 | MRLHYLLFVFLILFLVPAPGDAFLPKTLRKFFCRIRG GRCAVLNCLGKEEQIGRCSNSGRKCCRKKK |
| 429 defensin beta 34; beta defensin 34 | Mus musculus | 81 | MKTFLFLFAVLFFWSQPRMHFFFFDEKCSRINGRCT ASCLKNEELVALCWKNLKCCVTVQSCGRSKGNQS DEGSGHMGTRG |
| 430 defensin beta 37; beta defensin 37 | Mus musculus | 62 | MKFSYFLLLLLSLSNFQNNPVAMLDTIACIENKDTCR LKNCPRLHNVVGTCYEGKGKCCHKN |
| 431 defensin beta 38; beta defensin 38 | Mus musculus | 63 | MKISCFLLLILSLYFFQINQAIGPDTKKCVQRKNACH YFECPWLYYSVGTCYKGKGKCCQKRY |
| 432 defensin beta 40; beta defensin 40 | Mus musculus | 73 | MKISCFLLMIFFLSCFQINPVAVLDTIKCLQGNNNCHI QKCPWFLLQVSTCYKGKGRCCQKRRWFARNHVYHV |
| 433 Defensin beta 5 | Mus musculus | 64 | MRIHYLLFAFLLVLLCPLASDFSKTINNPVSCCMIGGI CRYLCKGNILQNGNCGVTSLNCCKRK |
| 434 Defensin C | Rhodnius prolixus | 94 | MKCILSLFTLFLVATLVYSYPAEWNSQHQLDDAQW EPAGELTEEHLSRMKRATCDLLSLTSKWFTPNHAG CAAHCIFLGNRGGRCVGTVCHCRK |
| 435 defensin C | Zophobas atratus | 43 | FTCDVLGFEIAGTKLNSAACGAHCLALGRTGGYCN SKSVCVCR |
| 436 Defensin C precursor | Aedes aegypti | 99 | MRTLIVVCFVALCLSAIFTTGSALPGELADDVRPYAN SLFDELPEESYQAAVENFRLKRATCDLLSGFGVGD SACAAHCIARRNGGYCNAKKVCVCRN |
| 437 Defensin D precursor (AALDEFD) (Fragment) | Aedes albopictus | 96 | VPTVICFLAMCLVAITGAYPQEPVLADEAQSVANSLF DELPEESYQAAVENLRLKRATCDLLSGFGVGDSAC AAHCIARGNRGGYCNSKKVCVCPI |
| 438 Defensin heliomicin | Heliothis virescens | 44 | DKLIGSCVWGAVNYTSDCNGECKRRGYKGGHCGS FANVNCWCET |
| 439 Defensin Heliomicin | Heliothis virescens | 44 | DKLIGSCVWGAVNYTSDCNGECLLRGYKGGHCGS FANVNCWCET |
| 440 defensin isoform A1 | Aedes aegypti | 98 | MKSITVICFLALCTGSITSAYPQDPVLADEARPFANS LFDELPEETYQAAVENFRLKRATCDLLSGFGVGDSA CAAHCIARGNRGGYCNSKKVCVCRN |
| 441 defensin isoform B1 | Aedes aegypti | 98 | MKSITVICFLALCTVAITSAYPQEPVLADEARPFANSL FDELPEETYQAAVENFRLKRATCDLLSGFGVGDSA CAAHCIARGNRGGYCNSQKVCVCRN |
| 442 defensin isoform B2 | Aedes aegypti | 98 | MKSITVICFLALCTGSITSAYPQEPVLADEARPFANS LFDELPEETYQAAVENFRLKRATCDLLSGFGVGDSA CAAHCIARGNRGGYCNSQKVCVCRN |
| 443 defensin isoform C1 | Aedes aegypti | 99 | MRTLIVVCFVALCLSAIFTTGSALPEELADDVRSYAN SLFDELPEESYQAAVENFRLKRATCDLLSGFGVGD SACAAHCIARRNGGYCNAKKVCVCRN |
| 444 Defensin Mgd-1 | Mytilus galloprovincialis | 39 | GFGCPNNYQCHRHCKSIPGRCGGYCGGWHRLRC TCYRCG |
| 445 Defensin MGD-1 | Mytilus galloprovincialis | 38 | GFGCPNNYQCHRHCKSIPGRCGGYCGGXHRLRCT CYRC |

TABLE 1-continued

| | | | |
|---|---|---|---|
| 446 Defensin MGD-2 precursor | *Mytilus galloprovincialis* | 81 | MKAAFVLLVVGLCIMTDVATAGFGCPNNYACHQHC KSIRGYCGGYCAGWFRLRCTCYRCGGRRDDVEDIF DIYDNVAVERF |
| 447 defensin NP-1 | *Rattus norvegicus* | 32 | VTCYCRRTRCGFRERLSGACGYRGRIYRLCCR |
| 448 defensin NP-4 | *Rattus norvegicus* | 31 | ACYCRIGACVSGERLTGACGLNGRIYRLCCR |
| 449 Defensin precursor | *Anopheles gambiae* | 102 | MKCATIVCTIAVVLAATLLNGSVQAAPQEEAALSGG ANLNTLLDELPEETHHAALENYRAKRATCDLASGFG VGSSLCAAHCIARRYRGGYCNSKAVCVCRN |
| 450 Defensin precursor | *Drosophila melanogaster* | 92 | MKFFVLVAIAFALLACVAQAQPVSDVDPIPEDHVLVH EDAHQEVLQHSRQKRATCDLLSKWNWNHTACAGH CIAKGFKGGYCNDKAVCVCRN |
| 451 Defensin precursor | *Oryctes rhinoceros* | 79 | MSRFIVFAFIVAMCIAHSLAAPAPEALEASVIRQKRLT CDLLSFEAKGFAANHSLCAAHCLAIGRKGGACQNG VCVCRR |
| 452 defensin precursor | *Spodoptera frugiperda* | 102 | MGVKVINVFLLIAVSACLIHAVAGKPNPRDSSVVEEQ SLGPIHNEDLEVKVKPETTTTPEPRIPGRVSCDFEEA NEDAVCQEHCLPKGYTYGICVSHTCSCI |
| 453 Defensin precursor (Fragment) | *Culex pipiens* | 40 | ATCDLLSGFGVNDSACAAHCILRGNRGGYCNGKKV CVCRN |
| 454 defensin R-2 | *Rattus norvegicus* | 31 | VTCSCRTSSCRFGERLSGACRLNGRIYRLCC |
| 455 defensin R-5 | *Rattus norvegicus* | 32 | VTCYCRSTRCGFRERLSGACGYRGRIYRLCCR |
| 456 defensin related cryptdin, related sequence 12 | *Mus musculus* | 92 | MKKLVLLSAFVLLAFQVQADSIQNTDEEIKTEEQPGE ENQAVSISFGDPEGYALQDAAAIRRARRCPPCPSCL SCPWCPRCLRCPMCKCNPK |
| 457 defensin related cryptdin, related sequence 7 | *Mus musculus* | 92 | MKKLVLLFALVLLAFQVQADSIQNTDEETKTEEQQG EEDQAVSVSFGDPQGSGLQDAAALGWRRCPRCP PCPRCSWCPRCPTCPRCNCNPK |
| 458 Defensin related peptide | *Mus musculus* | 60 | MRIHYLLFTFLLVLLSPLAAFSQKINDPVTYIRNGGIC QYRCIGLRHKIGTCGSPFKCCK |
| 459 Defensin, isoforms B and C | *Zophobas atratus* | 43 | FTCDVLGFEIAGTKLNSAACGAHCLALGRRGGYCN SKSVCVCR |
| 460 defensin-3 | *Macaca mulatta* | 96 | MRTLVILAAILLVALQAQAEPLQARTDEATAAQEQIP TDNPEVVVSLAWDESLAPKDSVPGLRKNMACYCRI PACLAGERRYGTCFYRRRVWAFCC |
| 461 defensin-8 | *Macaca mulatta* | 96 | MRTLVILAAILLVALQAQAEPLQARTDEATAAQEQIP TDNPEVVVSLAWDESLAPKDSVPGLRKNMACYCRI PACLAGERRYGTCFYLRRVWAFCC |
| 462 defensin-like gene 1C-1 | *Mus musculus* | 5 | ICSPK |
| 463 Defensin-like peptide 1 (DLP-1) | *Ornithorhynchus anatinus* | 42 | FVQHRPRDCESINGVCRHKDTVNCREIFLADCYND GQKCCRK |
| 464 Defensin-like peptide 2/4 (DLP-2/DLP-4) | *Ornithorhynchus anatinus* | 42 | IMFFEMQACWSHSGVCRDKSERNCKPMAWTYCEN RNQKCCEY |
| 465 Defensin-like peptide 3 (DLP-3) | *Ornithorhynchus anatinus* | 38 | FEMQYCWSHSGVCRDKSERNNKPMAWTYCENRQ KKCEF |
| 466 Defensin-like protein TXKS2 | *Mesobuthus martensii* | 61 | MTYAILIIVSLLPISDGISNVVDKYCSENPLDCNEHCL KTKNQIGICHGANGNEKCSCMES |
| 467 Demidefensin 2 | *Macaca mulatta* | 76 | MRTFALLTAMLLLVALHAQAEARQARADEAAAQQQ PGADDQGMAHSFTWPENAALPLSESAKGLRCICTR GFCRLL |

TABLE 1-continued

| | | | |
|---|---|---|---|
| 468 Demidefensin 3 | Macaca mulatta | 76 | MRTLALHTAMLLLVALHAQAEARQARADEAAAQQQ PGADDQGMAHSFTWPENAALPLSESERGLRCICVL GICRLL |
| 469 Dermaseptin 1 (DS I) | Phyllomedusa sauvagei | 34 | ALWKTMLKKLGTMALHAGKAALGAAADTISQGTQ |
| 470 Dermaseptin BI precursor (Dermaseptin B1) | Phyllomedusa bicolor | 78 | MDILKKSLFLVLFLGLVSLSICEEEKRENEDEEKQDD EQSEMKRAMWKDVLKKIGTVALHAGKAALGAVADT ISQGEQ |
| 471 Dermaseptin DRG3 precursor (Dermaseptin 3) | Phyllomedusa bicolor | 77 | MAFLKKSLFLVLFLGLVSLSVCEEEKRENEDEEEQE DDEQSEEKRALWKTIIKGAGKMIGSLAKNLLGSQAQ PESEQ |
| 472 Dermatoxin precursor | Phyllomedusa bicolor | 77 | MAFLKKSLFLVLFLGLVPLSLCESEKREGENEEEQE DDQSEEKRSLGSFLKGVGTTLASVGKVVSDQFGKL LQAGQG |
| 473 Diptericin A | Protophormia terraenovae | 82 | DEKPKLILPTPAPPNLPQLVGGGGGNRKDGFGVSV DAHQKVWTSDNGGHSIGVSPGYSQHLPGPYGNSR PDYRIGAGYSYNF |
| 474 diptericin B | Protophormia terraenovae | 41 | DEKPKLVLPSXAPPNLPQLVGGGGGNNKXGXXVSI NAAQKV |
| 475 diptericin C | Protophormia terraenovae | 39 | DEKPKLIXPXXAPXNLXQLVGGGGGNNKKXXGVXV XXAQ |
| 476 Diptericin D precursor | Protophormia terraenovae | 101 | MKLFYLLVICALSLAVMADEKPKLILPTPAPPNLPQL VGGGGGNRKDGFGVSVDAHQKVWTSDNGRHSIG VTPGYSQHLGGPYGNSRPDYRIGAGYSYNFG |
| 477 Dolabellanin B2 | Dolabella auricularia | 33 | SHQDCYEALHKCMASHSKPFSCSMKFHMCLQQQ |
| 478 Drosocin | Drosophila melanogaster | 64 | MKFTIVFLLLACVFAMAVATPGKPRPYSPRPTSHPR PIRVRREALAIEDHLTQAAIRPPPILPA |
| 479 Drosocin | Drosophila melanogaster | 64 | MKFTIVFLLLACVFAMAVATPGKPRPYSPRPTSHPR PIRVRREALAIEDHLTQAAIRPPPILPV |
| 480 Drosocin CG10816-PA | Drosophila melanogaster | 64 | MKFTIVFLLLACVFAMGVATPGKPRPYSPRPTSHPR PIRVRREALAIEDHLTQAAIRPPPILPA |
| 481 Drosocin precursor | Drosophila melanogaster | 64 | MKFTIVFLLLACVFAMAVATPGKPRPYSPRPTSHPR PIRVRREALAIEDHLAQAAIRPPPILPA |
| 482 Drosomysin | Drosophila melanogaster | 44 | DCLSGRYKGPCAVWDNETCRRVCKEEGRSSGHCS PSLKCWCEGC |
| 483 Drosomycin precursor (Cysteine-rich peptide) | Drosophila melanogaster | 70 | MMQIKYLFALFAVLMLVVLGANEADADCLSGRYKG PCAVWDNETCRRVCKEEGRSSGHCSPSLKCWCE GC |
| 484 enbocin | Bombyx mori | 59 | MNFTRIIFFLGVVVFATASGKPWNIFKEIERAVARTR DAVISAGPAVATVAAATSVASG |
| 485 Enhancer of rudimentary homolog [Contains: Antibacterial peptide 3910] (Fragment) | Sus scrofa | 32 | RADTQTYQPYNKDWIKEKIYVLLRRQAQQAGK |
| 486 enteric beta defensin preproprotein | Bubalus bubalis | 64 | MRLHHLLLALLFLVLSAGSGFTQGVRNPQSCHRNK GICVPIRCPGNMRQIGTCLGPPVKCCRRK |
| 487 Enteric beta-defensin precursor | Bos taurus | 64 | MRLHHLLLTLLFLVLSAGSGFTQGISNPLSCRLNRGI CVPIRCPGNLRQIGTCFTPSVKCCRWR |

TABLE 1-continued

| | | | |
|---|---|---|---|
| 488 Eosinophil granule major basic protein 1 precursor (MBP-1) | *Cavia porcellus* | 233 | MKLLLLLALLLGAVSTRHLKVDTSSLQSLRGEESLA QDGETAEGATREATAGALMPLPEEEEMEGASGSE DDPEEEEEEEEEVEFSSELDVSPEDIQCPKEEDTVK FFSRPGYKTRGYVMVGSARTFNEAQWVCQRCYRG NLASIHSFAFNYQVQCTSAGLNVAQVWIGGQLRGK GRCRRFVWVDRTVWNFAYWARGQPWGGRQRGR CVTLCARGGHWRRSHCGKRRPFVCTY |
| 489 EP2e (ANTI-microbial-like protein BIN-1B homolog) | *Mus musculus* | 69 | MKVLLLFAVFFCFVQGNSGDIPPGIRNTVCLMQQGH CRLFMCRSGERKGDICSDPWNRCCVPYSVKDRR |
| 490 Esculentin-1 | *Rana esculenta* | 46 | GIFSKLGRKKIKNLLISGLKNVGKEVGMDVVRTGIDIA GCKIKGEC |
| 491 Esculentin-1A | *Rana esculenta* | 46 | GIFSKLAGKKIKNLLISGLKNVGKEVGMDVVRTGIDIA GCKIKGEC |
| 492 Esculentin-1B precursor | *Rana esculenta* | 84 | MFTLKKPLLLIVLLGMISLSLCEQERNADEEEGSEIK RGIFSKLAGKKLKNLLISGLKNVGKEVGMDVVRTGID IAGCKIKGEC |
| 493 Esculentin-2A | *Rana esculenta* | 37 | GILSLVKGVAKLAGKGLAKEGGKFGLELIACKIAKQC |
| 494 Esculentin-2B | *Rana berlandieri* | 37 | GLFSILRGAAKFASKGLGKDLTKLGVDLVACKISKQC |
| 495 Esculentin-2B | *Rana esculenta* | 37 | GIFSLVKGAAKLAGKGLAKEGGKFGLELIACKIAKQC |
| 496 Esculentin-2L | *Rana luteiventris* | 37 | GILSLFTGGIKALGKTLFKMAGKAGAEHLACKATNQC |
| 497 Esculentin-2P | *Rana pipiens* | 37 | GFSSIFRGVAKFASKGLGKDLARLGVNLVACKISKQC |
| 498 Formaecin 1 | *Myrmecia gulosa* | 16 | GRPNPVNNKPTPHPRL |
| 499 Formaecin 2 | *Myrmecia gulosa* | 16 | GRPNPVNTKPTPYPRL |
| 500 Gaegurin-1 | *Rana rugosa* | 33 | SLFSLIKAGAKFLGKNLLKQGACYAACKASKQC |
| 501 Gaegurin-2 | *Rana rugosa* | 33 | GIMSIVKDVAKNAAKEAAKGALSTLSCKLAKTC |
| 502 Gaegurin-3 | *Rana rugosa* | 33 | GIMSIVKDVAKTAAKEAAKGALSTLSCKLAKTC |
| 503 Gaegurin-4 precursor | *Rana rugosa* | 80 | MFTMKKSLLFLFFLGTISLSLCEEERSADEDDGGEM TEEEVKRGILDTLKQFAKGVGKDLVKGAAQGVLSTV SCKLAKTC |
| 504 Gaegurin-5 precursor | *Rana rugosa* | 65 | MFTLKKSLLLLFFLGTISLSLCEEERNADEEEKRDVE VEKRFLGALFKVASKVLPSVFCAITKKC |
| 505 Gaegurin-6 | *Rana rugosa* | 24 | FLPLLAGLAANFLPTIICKISYKC |
| 506 Gal-1 alpha | *Gallus gallus* | 65 | MRIVYLLLPFILLLAQGAAGSSQALGRKSDCFRKNG FCAFLKCPYLTLISGKCSRFHLCCKRIWG |
| 507 gallinacin | *Gallus gallus* | 39 | GRKSDCFRKSGFCAFLKCPSLTLISGKCSRFYLCCK RIW |
| 508 gallinacin | *Gallus gallus* | 36 | LFCKGGSCHFGGCPSHLIKVGSCFGFRSCCKWPW NA |
| 509 Gallinacin 1 alpha | *Gallus gallus* | 39 | GRKSDCFRKNGFCAFLKCPYLTLISGKCSRFHLCCK RIW |
| 510 Gallinacin 1 precursor | *Gallus gallus* | 65 | MRIVYLLLPFILLLAQGAAGSSQALGRKSDCFRKSG FCAFLKCPSLTLISGKCSRFYLCCKRIWG |

TABLE 1-continued

| | | | |
|---|---|---|---|
| 511 Gallinacin 2 precursor | *Gallus gallus* | 64 | MRILYLLFSLLFLALQVSPGLSSPRRDMLFCKGGSC HFGGCPSHLIKVGSCFGFRSCCKWPWNA |
| 512 Gastric inhibitory polypeptide (GIP) (Glucose-dependent insulinotropic polypeptide) | *Sus scrofa* | 42 | YAEGTFISDYSIAMDKIRQQDFVNWLLAQKGKKSD WKHNITQ |
| 513 Gloverin | *Hyalophora cecropia* | 130 | DVTWDKNIGNGKVFGTLGQNDDGLFGKAGFKQQF FNDDRGKFEGQAYGTRVLGPAGGTTNFGGRLDWS DKNANAALDISKQIGGRPNLSASGAGVWDFDKNTR LSAGGSLSTMGRGKPDVGVHAQFQHDF |
| 514 Gomesin | *Acanthoscurria gomesiana* | 18 | QCRRLCYKQRCVTYCRGR |
| 515 GP-CS2 =CORTICO STATIC peptide (Fragment) | *Cavia* | 31 | RRCICTTRTCRFPYRRLGTCLFQNRVYTFCC |
| 516 Hadrurin | *Hadrurus aztecus* | 41 | GILDTIKSIASKVWNSKTVQDLKRKGINWVANKLGVS PQAA |
| 517 Hemiptericin | *Pyrrhocoris apterus* | 133 | DVELKGKGGENEGFVGLKAQRNLYEDDRTSLSGTV KGQSQWKDPYPAQHAGMARLDGTRTLIENDRTKV TGSGFAQREVATGMRPHDSFGVGVEATHNIYKGKN GEVDVFGGVQRQWNTPDRHQARGGIRWRF |
| 518 Hepcidin antimicrobial peptide 2 | *Mus musculus* | 83 | MALSTRTQAACLLLLLLASLSSTTYLQQQMRQTTEL QPLHGEESRADIAIPMQKRRKRDINFPICRFCCQCC NKPSCGICCEE |
| 519 hepcidin antimicrobial peptide precursor | *Danio rerio* | 91 | MKLSNVFLAAVVILTCVCVFQITAVPFIQQVQDEHHV ESEELQENQHLTEAEHRLTDPLVLFRTKRQSHLSLC RFCCKCCRNKGCGYCCKF |
| 520 Hepcidin precursor | *Morone chrysops × Morone saxatilis* | 85 | MKTFSVAVAVAVVLAFICLQESSAVPVTEVQELEEP MSNEYQEMPVESWKMPYNNRHKRHSSPGGCRFC CNCCPNMSGCGVCCRF |
| 521 Hepcidin precursor | *Mus musculus* | 83 | MALSTRTQAACLLLLLLASLSSTTYLHQQMRQTTEL QPLHGEESRADIAIPMQKRRKRDTNFPICIFCCKCC NNSQCGICCKT |
| 522 Hepcidin precursor | *Rattus norvegicus* | 84 | MALSTRIQAACLLLLLLASLSSGAYLRQQTRQTTALQ PWHGAESKTDDSALLMLKRRKRDTNFPICLFCCKC CKNSSCGLCCIT |
| 523 Hepcidin precursor (Fragment) | *Oncorhynchus mykiss* | 61 | LQVLTEEVGSIDSPVGEHQQPGGESMRLPEHFRFK RXSHLSLCRWCCNCCHNKGXGFCCKF |
| 524 Histone H2A [Contains: Buforin I; Buforin II] (Fragment) | *Bufo gargarizans* | 39 | AGRGKQGGKVRAKAKTRSSRAGLQFPVGRVHRLL RKGNY |
| 525 Histone H2A [Contains: Hipposin] (Fragment) | *Hippoglossus hippoglossus* | 51 | SGRGKTGGKARAKAKTRSSRAGLQFPVGRVHRLL RKGNYAHRVGAGAPVYL |
| 526 Histone H2B-1 (Antibacterial histone-like protein 1) (HLP-1) (Fragment) | *Ictalurus punctatus* | 20 | PDPAKTAPKKGSKKAVTKXA |
| 527 Histone H2B-3 (Antibacterial histone-like | *Ictalurus punctatus* | 17 | PDPAKTAPKKKSKKAVT |

TABLE 1-continued

| | | | |
|---|---|---|---|
| | protein 3) (HLP-3) (Fragment) | | |
| 528 | holotricin 1 | *Holotrichia diomphalia* | 43 | VTCDLLSLQIKGIAINDSACAAHCLAMRRKGGSCKQ GVCVCRN |
| 529 | Holotricin 2 precursor | *Holotrichia diomphalia* | 127 | MMKLVIALCLIGISAAYVVPVYYEIYPEDATFDEADIE PQLSPAELHHGSIRERRSLQPGAPSFPMPGSQLPT SVSGNVEKQGRNTIATIDAQHKTDRYDVRGTWTKV VDGPGRSKPNFRIGGSYRW |
| 530 | holotricin 2 precursor | *Holotrichia diomphalia* | 127 | MMKLVIALCLIGISAAYVVPVYYEIYPEDATFDEADIE PQLSPAELHHGSIRERRSLQPGAPSLSQLPTSVSGN VEKQGRPMPGNTIATIDAQHKTDRYDVRGTVDGPG RSKPNFRIGGSWTKVYRW |
| 531 | Holotricin 3 precursor | *Holotrichia diomphalia* | 104 | MNKLIILGLACIIAVASAMPYGPGDGHGGGHGGGHG GGHGNGQGGGHGHGPGGGFGGGHGGGHGGGG RGGGGSGGGGSPGHGAGGGYPGGHGGGHHGGY QTHGY |
| 532 | Hymenoptaecin precursor | *Apis mellifera* | 129 | MKFIVLVLFCAVAYVSAQAELEPEDTMDYIPTRFRR QERGSIVIQGTKEGKSRPSLDIDYKQRVYDKNGMT GDAYGGLNIRPGQPSRQHAGFEFGKEYKNGFIKGQ SEVQRGPGGRLSPYFGINGGFRF |
| 533 | Indolicidin | *Bos taurus* | 14 | ILPWKWPWWPWRRX |
| 534 | Indolicidin precursor | *Bos taurus* | 144 | MQTQRASLSLGRWSLWLLLLGLVVPSASAQALSYR EAVLRAVDQLNELSSEANLYRLLELDPPPKDNEDLG TRKPVSFTVKETVCPRTIQQPAEQCDFKEKGRVKQ CVGTVTLDPSNDQFDLNCNELQSVILPWKWPWWP WRRG |
| 535 | Insect Defensin A (NMR, 10 Structures) - Chai | *Protophormia terraenovae* | 40 | ATCDLLSGTGINHSACAAHCLLRGNRGGYCNGKGV CVCRN |
| 536 | Interferon-activated antimicrobial protein (Fragment) | *Mus sp.* | 15 | SETAPAETPAPAKAE |
| 537 | Japonicin-1 | *Rana japonica* | 14 | FFPIGVFCKIFKTC |
| 538 | Japonicin-2 | *Rana japonica* | 21 | FGLPMLSILPKALCILLKRKC |
| 539 | Lactoferricin | *Bos taurus* | 25 | FKCRRWQWRMKKLGAPSITCVRRAF |
| 540 | lactoferrin precursor | *Sus scrofa* | 703 | MKLFIPALLFLGTLGLCLAAPKKGVRWCVISTAEYSK CRQWQSKIRRTNPMFCIRRASPTDCIRAIAAKRADA VTLDGGLVFEADQYKLRPVAAEIYGTEENPQTYYA VAVVKKGFNFQNQLQGRKSCHTGLGRSAGWNIPIG LLRRFLDWAGPPEPLQKAVAKFFSQSCVPCADGNA YPNLCQLCIGKGKDKCACSSQEPYFGYSGAFNCLH KGIGDVAFVKESTVFENLPQKADRDKYELLCPDNTR KPVEAFRECHLARVPSHAVVARSVNGKENSIWELL YQSQKKFGKSNPQEFQLFGSPGQQKDLLFRDATIG FLKIPSKIDSKLYLGLPYLTAIQGLRETAAEVEARQAK VVWCAVGPEELRKCRQWSSQSSQNLNCSLASTTE DCIVQVLKGEADAMSLDGGFIYTAGKCGLVPVLAEN QKSRQSSSDCVHRPTQGYFAVAVVRKANGGITW NSVRGTKSCHTAVDRTAGWNIPMGLLVNQTGSCKF DEFFSQSCAPGSQPGSNLCALCVGNDQGVDKCVP NSNERYYGYTGAFRCLAENAGDVAFVKDVTVLDNT NGQNTEEWARELRSDDFELLCLDGTRKPVTEAQNC HLAVAPSHAVVSRKEKAAQVEQVLLTEQAQFGRYG KDCPDKFCLFRSETKNLLFNDNTECLAQLQGKTTYE KYLGSEYVTAIANLKQCSVSPLLEACAFMMR |
| 541 | Lactotransferrin precursor (Lactoferrin) [Contains: | *Bos taurus* | 708 | MKLFVPALLSLGALGLCLAAPRKNVRWCTISQPEWF KCRRWQWRMKKLGAPSITCVRRAFALECIRAIAEKK ADAVTLDGGMVFEAGRDPYKLRPVAAEIYGTKESP QTHYYAVAVVKKGSNFQLDQLGRKSCHTGLGRS |

TABLE 1-continued

| | | | |
|---|---|---|---|
| Lactoferricin B (LFCIN B)] | | | AGWIIPMGILRPYLSWTESLEPLQGAVAKFFSASCV PCIDRQAYPNLCQLCKGEGENQCACSSREPYFGYS GAFKCLQDGAGDVAFVKETTVFENLPEKADRDQYE LLCLNNSRAPVDAFKECHLAQVPSHAVVARSVDGK EDLIWKLLSKAQEKFGKNKSRSFQLFGSPPGQRDLL FKDSALGFLRIPSKVDSALYLGSRYLTTLKNLRETAE EVKARYTRVVWCAVGPEEQKKCQQWSQQSGQNV TCATASTTDDCIVLVLKGEADALNLDGGYIYTAGKC GLVPVLAENRKSSKHSSLDCVLRPTEGYLAVAVVKK ANEGLTWNSLKDKKSCHTAVDRTAGWNIPMGLIVN QTGSCAFDEFFSQSCAPGADPKSRLCALCAGDDQ GLDKCVPNSKEKYYGYTGAFRCLAEDVGDVAFVKN DTVWENTNGESTADWAKNLNREDFRLLCLDGTRK PVTEAQSCHLAVAPNHAVVSRSDRAAHVKQVLLHQ QALFGKNGKNCPDKFCLFKSETKNLLFNDNTECLAK LGGRPTYEEYLGTEYVTAIANLKKCSTSPLLEACAFL TR |
| 542 Lebocin 1/2 precursor | Bombyx mori | 179 | MYKFLVFSSVLVLFFAQASCQRFIQPTFRPPPTQRPI IRTARQAGQEPLWLYQGDNVPRAPSTADHPILPSKI DDVQLDPNRRYVRSVTNPENNEASIEHSHHTVDTG LDQPIESHRNTRDLRFLYPRGKLPVPTPPPFNPKPIY IDMGNRYRRHASDDQEELRQYNEHFLIPRDIFQE |
| 543 Lebocin 3 precursor (LEB 3) | Bombyx mori | 179 | MYKFLVFSSVLVLFFAQASCQRFIQPTFRPPPTQRPI TRTVRQAGQEPLWLYQGDNVPRAPSTADHPILPSKI DDVQLDPNRRYVRSVTNPENNEASIEHSHHTVDIGL DQPIESHRNTRDLRFLYPRGKLPVPTLPPFNPKPIYI DMGNRYRRHASEDQEELRQYNEHFLIPRDIFQE |
| 544 lectin-L6 | Limulus polyphemus | 221 | VQWHQIPGKLMHITATPHFLWGVNSNQQIYLCRQP CYDGQWTQISGSLKQVDADDHEVWGVNRNDDIYK RPVDGSGSWVRVSGKLKHVSASGYGYIWGVNSND QIYKCPKPCNGAWTQVNGRLKQIDGGQSMVYGVN SANAIYRRPVDGSGSWQQISGSLKHITGSGLSEVFG VNSNDQIYRCTKPCSGQWSLIDGRLKQCDATGNTIV GVNSVDNIYRSG |
| 545 Limulus factor D | Tachypleus tridentatus | 394 | MKVLLLVAFLLGTTLAYPQDDDGPVWGGSSNDNDD GGIISSRVGNPQSGFGNCECVPYYLCKDNNIIIDSGG LLDPRKKPVASKEPKLSARLGPEGPSGCGPPHVCCI APETSTVKPYTHQCGFRNVNGINKRILSPNGKDLSE FGEWPWQGAVLKVEGKVNIFQCGAVLIDSYHLLTV AHCVYKFTLENAFPLKVRLGEWDTQNTNEFLKHED YEVEKIYIHPKYDDERKNLWDDIAILKLKAEVSFGPHI DTICLPNNQEHFAGVQCVVTGWGKNAYKNGSYSN VLREVHVPVITNDRCQELLRKTRLSEWYVLYENFIC AGGESNADSCKGDGGGPLTCWRKDGTYGLAGLVS WGINCGSPNVPGVYVRVSNYLDWITKITGRPISDYW PRS |
| 546 Lingual antimicrobial peptide precursor | Bos taurus | 64 | MRLHHLLLALLFLVLSAGSGFTQGVRNSQSCRRNK GICVPIRCPGSMRQIGTCLGAQVKCCRRK |
| 547 Liver-expressed antimicrobial peptide 2 precursor (LEAP-2) | Bos taurus | 77 | MWHLKLFAVLMICLLLLAQVDGSPIPQQSSAKRRPR RMTPFWRAVSLRPIGASCRDDSECITRLCRKRRCS LSVAQE |
| 548 Liver-expressed antimicrobial peptide 2 precursor (LEAP-2) | Macaca mulatta | 77 | MWHLKLCAVLMIFLLLLGQTDGSPIPEVSSAKRRPR RMTPFWRGVSLRPIGASCRDDSECITRLCRKRRCS LSVAQE |
| 549 Liver-expressed antimicrobial peptide 2 precursor (LEAP-2) | Mus musculus | 76 | MLQLKLFAVLLTCLLLLGQVNSSPVPEVSSAKRSRR MTPFWRGVSLRPIGASCRDDSECITRLCRKRRCSL SVAQE |
| 550 Liver-expressed antimicrobial peptide 2 precursor (LEAP-2) | Sus scrofa | 77 | MWHLKLFAVLVICLLLLAVQVHGSPIPELSSAKRRPR RMTPFWRAVSLRPIGASCRDDSECLTRLCRKRRCS LSVAQE |

TABLE 1-continued

| | | | |
|---|---|---|---|
| 551 Liver-expressed antimicrobial peptide 2 precursor (LEAP-2) (Fragment) | *Cavia porcellus* | 71 | SVVLLICLLLLGQVDGSPVPEKSSVKKRLRRMTPFW RGVSLRPIGASCRDDSECITRLCKKRRCSLSVAQE |
| 552 Liver-expressed antimicrobial protein 2 | *Sus scrofa* | 77 | MWHLKLFAVLVICLLLAVQVHGSPIPELSSAKRRPR RITPFWRAVSLRPIGASCRDDSECLTRLCRKRRCSL SVAQE |
| 553 Lysozyme | *Heliothis virescens* | 141 | MQKLTLFVVALAAVVLHCEAKQFSRCGLVQELRRQ GFPEDKLGDWVCLVENESARKTDKVGTVNKNGSR DYGLYQINDKYWCSNTSTPGKDCNVTCAEMLLDDI TKASTCAKKIYKRHKFEAWYGWKNHCKGKTLPDIS NC |
| 554 lysozyme (EC 3.2.1.17) | *Alopochen aegyptiacus* | 129 | KVYGRCELAAAMKRLGLDNYRGYSLGNWVCAAKY ESGFNTQATNRNTDGSTDYGILQINSRWWCNDGKT PRAKNVCGIPCSVLLRSDITEAVKCAKRIVSDGNGM NAWVAWRNRCKGTDVSQWIRGCRL |
| 555 lysozyme (EC 3.2.1.17) | *Chrysolophus pictus* | 129 | KVYGRCELAAAMKRLGLDNYRGYSLGNWVCAAKF ESNFNTHATNRNTDGSTDYGILQINSRWWCNDGRT PGSRNLCHIPCSALLSSDITASVNCAKKIVSDGNGM NAWVAWRNRCKGTDVNAWTRGCRL |
| 556 lysozyme (EC 3.2.1.17) | *Lophophorus impejanus* | 129 | KVYGRCELAAAMKRLGLDNYRGYSLGNWVCAAKF ESNFNTHATNRNTDGSTDYGILQINSRWWCNDGRT PGSRNLCNIPCSALLSSDITASVNCAKKIVSDGNGM NAWVAWRNRCKGTDVHAWIRGCRL |
| 557 lysozyme (EC 3.2.1.17) | *Manduca sexta* | 120 | KHFSRCELVHELRRQGFPENLMRDWVCLVENESS RYTDKVGRVNKNGSRDYGLFQINDKYWCSNGSTP GKDCNVKCSDLLIDDITKASTCAKKIYKRHKFQAWY GWRNHCQGSLPDISSC |
| 558 lysozyme (EC 3.2.1.17) 1 | *Ovis aries* | 129 | KVFERCELARTLKELGLDGYKGVSLANWLCLTKWE SSYNTKATNYNPGSESTDYGIFQINSKWWCNDGKT PNAVDGCHVSCSELMENNIAKAVACAKHIVSEQGIT AWVAWKSHCRDHDVSSYVEGCSL |
| 559 lysozyme (EC 3.2.1.17) 1 precursor | *Rattus norvegicus* | 148 | MKALLVLGFLLLSASVQAKIYERCEFARTLKRNGMS GYYGVSLADWVCLAQHESNYNTQARNYNPGDQST DYGIFQINSRYWCNDGKTPRAKNACGIPCSALLQDD ITQAIQCAKRVVRDPQGIRAWVAWQRHCKNRDLSG YIRNCGV |
| 560 lysozyme (EC 3.2.1.17) 14d, tracheal | *Bos taurus* | 129 | KTFKRCELARTLKNLGLAGYKGVSLANWMCLAKGE SNYNTQAKNYNPGSKSTDYGIFQINSKWWCNDGKT PKAVNGCGVSCSALLKDDITQAVACAKKIVSQQGIT AWVAWKNKCRNRDLTSYVKGCGV |
| 561 lysozyme (EC 3.2.1.17) 2 | *Cervus axis* | 129 | KVFERCELARTLKELGLDGYKGVSLANWLCLTKWE SSYNTKATNYNPGSESTDYGIFQINSKWWCNDGKT PNAVDGCHVACSELMENDIAKAVACAKQIVREQGIT AWVAWKSHCRDHDVSSYVEGCTL |
| 562 lysozyme (EC 3.2.1.17) 2 | *Ovis aries* | 129 | KVFERCELARTLKELGLDGYKGVSLANWLCLTKWE SSYNTKATNYNPGSESTDYGIFQINSKWWCNDGKT PNAVDGCHVSCSALMENDIEKAVACAKHIVSEQGIT AWVAWKSHCRDHDVSSYVEGCTL |
| 563 lysozyme (EC 3.2.1.17) 3 | *Ovis aries* | 129 | KVFERCELARTLKKLGLDDYKGVSLANWLCLTKWE SGYNTKATNYNPGSESTDYGIFQINSKWWCNDGKT PNAVDGCHVSCSALMENDIEKAVACAKHIVSEQGIT AWVAWKSHCRDHDVSSYVEGCTL |
| 564 lysozyme (EC 3.2.1.17) 5a, tracheal | *Bos taurus* | 130 | KVFERCELARSLKRFGMDNFRGISLANWMCLARWE SNYNTQATNYNAGDQSTDYGIFQINSHWWCNDGK TPGAVNACHLPCGALLQDDITQAVACAKRVVSDPQ GIRAWVAWRSHCQNQDLTSYIQGCGV |
| 565 lysozyme (EC 3.2.1.17) B precursor | *Drosophila melanogaster* | 140 | MKAFIVLVALASGAPALGRTMDRCSLAREMSNLGV PRDQLARWACIAEHESSYRTGVVGPENYNGSNDY GIFQINDYYWCAPPSGRFSYNECGLSCNALLTDDIT HSVRCAQKVLSQQGWSAWSTWHYCSGWLPSIDD CF |

TABLE 1-continued

| | | | |
|---|---|---|---|
| 566 lysozyme (EC 3.2.1.17) c | *Papio* sp. | 130 | KIFERCELARTLKRLGLDGYRGISLANWVCLAKWES DYNTQATNYNPGDQSTDYGIFQINSHYWCNDGKTP GAVNACHISCNALLQDNITDAVACAKRVVSDPQGIR AWVAWRNHCQNRDVSQYVQGCGV |
| 567 lysozyme (EC 3.2.1.17) c [validated] | *Numida meleagris* | 129 | KVFGRCELAAAMKRHGLDNYRGYSLGNWVCAAKF ESNFNSQATNRNTDGSTDYGVLQINSRWWCNDGR TPGSRNLCNIPCSALQSSDITATANCAKKIVSDGDG MNAWVAWRKHCKGTDVRVWIKGCRL |
| 568 lysozyme (EC 3.2.1.17) C precursor | *Coturnix japonica* | 129 | KVYGRCELAAAMKRHGLDKYQGYSLGNWVCAAKF ESNFNTQATNRNTDGSTDYGILQINSRWWCNDGRT PGSRNLCNIPCSALLSSDITASVNCAKKIVSDVHGM NAWVAWRNRCKGTDVNVWIRGCRL |
| 569 lysozyme (EC 3.2.1.17) c precursor | *Hyalophora cecropia* | 132 | CRSWQFALHCDAKRFTRCGLVQELRRGFDETLM SNWVCLVENESGRFTDKIGKVNKNGSRDYGLFQIN DKYWCSKGSTPGKDCNVTCNQLLTDDISVAATCAK KIYKRHKFDAWYGWKNHCQHGLPDISDC |
| 570 lysozyme (EC 3.2.1.17) c precursor [validated] | *Phasianus colchicus* | 147 | MRSLLILVLCFLPLAAPGKVYGRCELAAAMKRMGLD NYRGYSLGNWVCAAKFESNFNTGATNRNTDGSTD YGILQINSRWWCNDGRTPGSKNLCHIPCSALLSSDI TASVNCAKKIVSDGDGMNAWVAWRKHCKGTDVNV WIRGCRL |
| 571 lysozyme (EC 3.2.1.17) E precursor | *Drosophila melanogaster* | 140 | MKAFIVLVALALAAPALGRTLDRCSLAREMSNLGVP RDQLARWACIAEHESSYRTGVVGPENYNGSNDYGI FQINDYYWCAPPSGRFSYNECGLSCNALLTDDITHS VRCAQKVLSQQGWSAWSTWHYCSGWLPSIDDCF |
| 572 lysozyme (EC 3.2.1.17) g | *Rhea americana* | 185 | RTNCYGDVSRIDTTGASCKTAKPEKLNYCGVAASR KIAERDLRSMDRYKTLIKKVGQKLCVEPAVIAGIISRE SHAGKALKNGWGDNGNGFGLMQVDRRSHKPVGE WNGERHLIQGTEILISMIKAMQRKFPRWTKEQQLKG GISAYNAGPGNVRTYERMDIGTTHDDYANDVVARA QYYKQHGY |
| 573 lysozyme (EC 3.2.1.17) g [validated] | *Casuarius casuarius* | 185 | QTGCYGVVNRIDTTGASCETAKPEKLNYCGVAASR KIAEGDLQSMDRYKTLIKKVGQKLCVDPAVIAGIISR ESHAGKALKDGWGDNGNGFGLMQVDKRSHTPVG KWNGERHLTQGTEILISMIKKIQKKFPRWTKEQQLK GGISAYNAGSGNVRTYERMDIGTTHNDYANDVVAR AQYYKQHGY |
| 574 lysozyme (EC 3.2.1.17) precursor | *Drosophila melanogaster* | 140 | MKAFIVLVALACAAPAFGRTMDRCSLAREMSNLGV PRDQLNKWACIAEHESSYRTGVVGPENYNGSNDY GIFQINDYYWCAPPSGRFSYNECGLSCNALLTDDIT HSVRCAQKVLSQQGWSAWSTWHYCSGWLPSIDD CF |
| 575 lysozyme (EC 3.2.1.17) precursor, stomach | *Opisthocomus hoazin* | 145 | MLFFGFLLAFLSAVPGTEGEIISRCELVKILREHGFE GFEGTTIADWICLVQHESDYNTEAYNNNGPSRDYGI FQINSKYWCNDGKTSGAVDGCHISCSELMTNDLED DIKCAKKIARDAHGLTPWYGWKNHCEGRDLSSYVK GC |
| 576 lysozyme (EC 3.2.1.17) S precursor | *Drosophila melanogaster* | 139 | MKAFFALVLLPLPLCLAGRTLDRCSLAREMADLGVP RDQLDKWTCIAQHESDYRTWVVGPANSDGSNDYG IFQINDLYWCQADGRFSYNECGLSCNALLTDDITNS VRCAQKVLSQQGWSAWAVVHYCSGWLPSIDECF |
| 577 lysozyme (EC 3.2.1.17) X | *Drosophila melanogaster* | 81 | PNTDGSNDYGIFQINDLYWCQPSSGKFSHNGCDVS CNALLTDDIKSSVRCALKVLGQQGWSAWSTWHYC SGYLPPIDDCFV |
| 578 Lysozyme A/C/D precursor (EC 3.2.1.17) (1,4-beta-N-acetylmuramidase A/C) | *Drosophila melanogaster* | 140 | MKAFIVLVALACAAPAFGRTMDRCSLAREMSNLGV PRDQLARWACIAEHESSYRTGVVGPENYNGSNDY GIFQINDYYWCAPPSGRFSYNECGLSCNALLTDDIT HSVRCAQKVLSQQGWSAWSTWHYCSGWLPSIDD CF |
| 579 Lysozyme C (EC 3.2.1.17) (1,4-beta-N-acetylmuramidase C) | *Callipepla californica* | 129 | KVFGRCELAAAMKRHGLDNYRGYSLGNWVCAAKF ESNFNSQATNRNTDGSTDYGVLQINSRWWCNDGR TPGSRNLCNIPCSALLSSDITATVNCAKKIVSDGNG MNAWVAWRNRCKGTDVHAWIRGCRL |

TABLE 1-continued

| | | | |
|---|---|---|---|
| 580 Lysozyme C (EC 3.2.1.17) (1,4-beta-N-acetylmuramidase C) | *Colinus virginianus* | 130 | MKVFGRCELAAAMKRHGLDNYRGYSLGNWVCAAK FESNFNSQATNRNTDGSTDYGVLQINSRWWCNDG KTPGSRNLCNIPCSALLSSDITATVNCAKKIVSDGNG MNAWVAWRNCKGTDVQAWIRGCRL |
| 581 Lysozyme C (EC 3.2.1.17) (1,4-beta-N-acetylmuramidase C) | *Columba livia* | 127 | KDIPRCELVKILRRHGFEGFVGKTVANWVCLVKHES GYRTTAFNNNGPNSRDYGIFQINSKYWCNDGKTRG SKNACNINCSKLRDDNIADDIQCAKKIAREARGLTP WVAWKKYCQGKDLSSYVRGC |
| 582 Lysozyme C (EC 3.2.1.17) (1,4-beta-N-acetylmuramidase C) | *Equus asinus* | 129 | KVFSKCELAHKLKAQEMDGFGGYSLANWVCMAEY ESNFNTRAFNGKNANGSYDYGLFQLNSKWWCKDN KRSSSNACNIMCSKLLDDNIDDDISCAKRVVRDPKG MSAWKAWVKHCKDKDLSEYLASCNL |
| 583 Lysozyme C (EC 3.2.1.17) (1,4-beta-N-acetylmuramidase C) | *Ortalis vetula* | 129 | KIYKRCELAAAMKRYGLDNYRGYSLGNWVCAARYE SNYNTQATNRNSNGSTDYGILQINSRWWCNDGRT PGTKNLCHISCSALMGADIAPSVRCAKRIVSDGDGM NAWVAWRKHCKGTDVSTWIKDCKL |
| 584 Lysozyme C (EC 3.2.1.17) (1,4-beta-N-acetylmuramidase C) | *Oryctolagus cuniculus* | 130 | KIYERCELARTLKKLGLDGYKGVSLANWMCLAKWE SSYNTRATNYNPGDKSTDYGIFQINSRYWCNDGKT PRAVNACHIPCSDLLKDDITQAVACAKRVVSDPQGI RAWVAWRNHCQNQDLTPYIRGCGV |
| 585 Lysozyme C (EC 3.2.1.17) (1,4-beta-N-acetylmuramidase C) (CPL) | *Syrmaticus soemmerringii* | 129 | KVYGRCELAAAMKRLGLDNFRGYSLGNWVCAAKF ESNFNTHATNRNTDGSTDYGILQINSRWWCNDGRT PGSRNLCNIPCSALLSSDTIASVNCAKKIVSDGNGM NAWVAWRKRCKGTDVNAWTRGCRL |
| 586 Lysozyme C (EC 3.2.1.17) (1,4-beta-N-acetylmuramidase C) (Fragment) | *Felis catus* | 20 | KIFTKCELARKLRAEGMDGF |
| 587 Lysozyme C (EC 3.2.1.17) (1,4-beta-N-acetylmuramidase C) (Fragment) | *Pseudocheirus peregrinus* | 49 | SKMKKCEFAKIAKEQHMDGYHGVSLADWVCLVNN ESDFNTKAINRNKGI |
| 588 Lysozyme C (EC 3.2.1.17) (1,4-beta-N-acetylmuramidase) | *Lophura leucomelanos* | 129 | KVYGRCELAAAMKRLGLDNYRGYSLGNWVCAAKY ESNFNTHATNRNTDGSTDYGILQINSRWWCNDGKT PGSRNLCHIPCSALLSSDITASVNCAKKIVSDGNGM NAWVAWRNCKGTDVSVWTRGCRL |
| 589 Lysozyme C (EC 3.2.1.17) (1,4-beta-N-acetylmuramidase) | *Pavo cristatus* | 129 | KVYGRCELAAAMKRLGLDNYRGYSLGNWVCAAKF ESNFNTHATNRNTDGSTDYGILQINSRWWCNDGRT PGSRNLCNIPCSALLSSDITASVNCAKKIVSDRNGM NAWVAWRNCKGTDVHAWIRGCRL |
| 590 Lysozyme C (EC 3.2.1.17) (1,4-beta-N-acetylmuramidase) | *Phasianus versicolor* | 130 | GKVYGRCELAAAMKRMGLDNYRGYSLGNWVCAAK FESNFNTGATNRNTDGSTDYGILQINSRWWCNDGR TPGSKNLCHIPCSALLSSDITASVNCAKKIVSDGDG MNAWVAWRKHCKGTDVNVWIRGCRL |
| 591 Lysozyme C (EC 3.2.1.17) (1,4-beta-N-acetylmuramidase) | *Syrmaticus reevesi* | 129 | KVYGRCELAAAMKRLGLDNYRGYSLGNWVCAAKF ESNFNTHATNRNTDGSTDYGILQINSRWWCNDGRT PGSRNLCHISCSALLSSDITASVNCAKKIVSDRNGM NAWVAWRNRCKGTDVNAWIRGCRL |
| 592 Lysozyme C 1 and 2 (EC 3.2.1.17) (1,4-beta-N-acetylmuramidase C) | *Cervus axis* | 129 | KVFERCELARTLKELGLDGYKGVSLANWLCLTKWE SSYNTKATNYNPGSESTDYGIFQINSKWWCDDGKT PNAVDGCHVACSELMENNIDKAVTCAKQIVREQGIT AWVAWKSHCRGHDVSSYVEGCTL |
| 593 Lysozyme C 1 precursor (EC | *Bos taurus* | 147 | MKALIILGFLFLSVAVQGKVFERCELARTLKKLGLDG YKGVSLANWLCLTKWESSYNTKATNYNPGSESTDY |

TABLE 1-continued

| | | | |
|---|---|---|---|
| 3.2.1.17) (1,4-beta-N-acetylmuramidase C) | | | GIFQINSKWWCNDGKTPNAVDGCHVSCSELMENDI AKAVACAKQIVSEQGITAWVAWKSHCRDHDVSSYV EGCTL |
| 594 Lysozyme C 2 precursor (EC 3.2.1.17) (1,4-beta-N-acetylmuramidase C) | Bos taurus | 147 | MKALVILGFLFLSVAVQGKVFERCELARTLKKLGLD GYKGVSLANWLCLTKWESSYNTKATNYNPSSESTD YGIFQINSKWWCNDGKTPNAVDGCHVSCSELMEN DIAKAVACAKHIVSEQGITAWVAWKSHCRDHDVSS YVEGCTL |
| 595 Lysozyme C 3 precursor (EC 3.2.1.17) (1,4-beta-N-acetylmuramidase C) | Bos taurus | 147 | MKALIILGFLFLSVAVQGKVFERCELARTLKKLGLDG YKGVSLANWLCLTKWESSYNTKATNYNPSSESTDY GIFQINSKWWCNDGKTPNAVDGCHVSCSELMENDI AKAVACAKHIVSEQGITAWVAWKSHCRDHDVSSYV QGCTL |
| 596 Lysozyme C I (EC 3.2.1.17) (1,4-beta-N-acetylmuramidase C) | Tachyglossus aculeatus | 125 | KILKKQELCKNLVAQGMNGYQHITLPNWVCTAFHES SYNTRATNHNTDGSTDYGILQINSRYWCHDGKTPG SKNACNISCSKLLDDDITDDLKCAKKIAGEAKGLTPW VAWKSKCRGHDLSKFKC |
| 597 Lysozyme C II precursor (EC 3.2.1.17) (1,4-beta-N-acetylmuramidase C) | Oncorhynchus mykiss | 144 | MRAVVVLLLVAVASAKVYDRCELARALKASGMDGY AGNSLPNWVCLSKWESSYNTQATNRNTDGSTDYGI FQINSRYWCDDGRTPGAKNVCGIRCSQLLTADLTV AIRCAKRVVLDPNGIGAWVAWRLHCQNQDLRSYVA GCGV |
| 598 Lysozyme C precursor (EC 3.2.1.17) (1,4-beta-N-acetylmuramidase C) | Coturnix japonica | 147 | MRSLLVLVLCFLPLAALGKVYGRCELAAAMKRHGLD KYQGYSLGNWVCAAKFESNFNTQATNRNTDGSTD YGILQINSRWWCNDGRTPGSRNLCNIPCSALLSSDI TASVNCAKKIVSDVHGMNAWVAWRNRCKGTDVNA WIRGCRL |
| 599 Lysozyme C precursor (EC 3.2.1.17) (1,4-beta-N-acetylmuramidase C) | Meleagris gallopavo | 147 | MRSLLILVLCFLPLAALGKVYGRCELAAAMKRLGLD NYRGYSLGNWVCAAKFESNFNTHATNRNTDGSTD YGILQINSRWWCNDGRTPGSKNLCNIPCSALLSSDI TASVNCAKKIASGGNGMNAWVAWRNRCKGTDVHA WIRGCRL |
| 600 Lysozyme C precursor (EC 3.2.1.17) (1,4-beta-N-acetylmuramidase C) | Presbytis entellus | 148 | MKALTILGLVLLSVTVQGKIFERCELARTLKKLGLDG YKGVSLANWVCLAKWESGYNTEATNYNPGDESTD YGIFQINSRYWCNNGKTPGAVDACHISCSALLQNNI ADAVACAKRVVSDPQGIRAWVAWRNHCQNKDVSQ YVKGCGV |
| 601 Lysozyme C precursor (EC 3.2.1.17) (1,4-beta-N-acetylmuramidase C) (Allergen Gal d 4) (Gal d IV) | Gallus gallus | 147 | MRSLLILVLCFLPLAALGKVFGRCELAAAMKRHGLD NYRGYSLGNWVCAAKFESNFNTQATNRNTDGSTD YGILQINSRWWCNDGRTPGSRNLCNIPCSALLSSDI TASVNCAKKIVSDGNGMNAWVAWRNRCKGTDVQA WIRGCRL |
| 602 Lysozyme C, type 2 precursor (EC 3.2.1.17) (1,4-beta-N-acetylmuramidase C) | Rattus norvegicus | 148 | MKALLVLGFLLLSASVQAKVFKHCELARILRSSALAG YRGVSLENWMCMAQHESNFDTEAINYNSTDQSTD YGIFQINSRYWCNDGKTPRAVNACGIPCSALLQDDI TQAIQCAKRVVRDPQGIRAWVAWQRHCQNRDLSG YIRNCGV |
| 603 Lysozyme C, type M precursor (EC 3.2.1.17) (1,4-beta-N-acetylmuramidase C) | Mus musculus | 148 | MKTLLTLGLLLLSVTAQAKVYERCEFARTLKRNGMA GYYGVSLADWVCLAQHESNYNTRATNYNRGDQST DYGIFQINSRYWCNDGKTPRAVNACGINCSALLQD DITAAIQCAKRVVRDPQGIRAWVAWRHCQNRDLS QYIRNCGV |

TABLE 1-continued

| | | | |
|---|---|---|---|
| 604 Lysozyme C, type P precursor (EC 3.2.1.17) (1,4-beta-N-acetylmuramidase C) | *Mus musculus* | 148 | MKALLTLGLLLLSVTAQAKVYNRCELARILKRNGMD GYRGVKLADWVCLAQHESNYNTRATNYNRGDRST DYGIFQINSRYWCNDGKTPRSKNACGINCSALLQD DITAAIQCAKRVVRDPQGIRAWVAWRTQCQNRDLS QYIRNCGV |
| 605 Lysozyme C-1 precursor (EC 3.2.1.17) (1,4-beta-N-acetylmuramidase C) | *Anas platyrhynchos* | 147 | MKALLTLVFCLLPLAAQGKVYSRCELAAAMKRLGLD NYRGYSLGNWVCAANYESGFNTQATNRNTDGSTD YGILQINSRWWCDNGKTPRSKNACGIPCSVLLRSDI TEAVRCAKRIVSDGDGMNAWVAWRNRCRGTDVSK WIRGCRL |
| 606 Lysozyme C-3 (EC 3.2.1.17) (1,4-beta-N-acetylmuramidase) | *Anas platyrhynchos* | 129 | KVYERCELAAAMKRLGLDNYRGYSLGNWVCAANY ESSFNTQATNRNTDGSTDYGILEINSRWWCDNGKT PRAKNACGIPCSVLLRSDITEAVKCAKRIVSDGDGM NAWVAWRNRCKGTDVSRWIRGCRL |
| 607 Lysozyme G (EC 3.2.1.17) (1,4-beta-N-acetylmuramidase) (Goose-type lysozyme) | *Anser anser* | 185 | RTDCYGNVNRIDTTGASCKTAKPEGLSYCGVSASK KIAERDLQAMDRYKTIIKKVGEKLCVEPAVIAGIISRE SHAGKVLKNGWGDRGNGFGLMQVDKRSHKPQGT WNGEVHITQGTTILINFIKTIQKKFPSWTKDQQLKGG ISAYNAGAGNVRSYARMDIGTTHDDYANDVVARAQ YYKQHGY |
| 608 Lysozyme G (EC 3.2.1.17) (1,4-beta-N-acetylmuramidase) (Goose-type lysozyme) | *Cygnus atratus* | 185 | RTDCYGNVNRIDTTGASCKTAKPEGLSYCGVPASK TIAERDLKAMDRYKTIIKKVGEKLCVEPAVIAGIISRE SHAGKVLKNGWGDRGNGFGLMQVDKRSHKPQGT WNGEVHITQGTTILTDFIKRIQKKFPSWTKDQQLKG GISAYNAGAGNVRSYARMDIGTTHDDYANDVVARA QYYKQHGY |
| 609 Lysozyme G (EC 3.2.1.17) (1,4-beta-N-acetylmuramidase) (Goose-type lysozyme) | *Struthio camelus* | 185 | RTGCYGDVNRVDTTGASCKSAKPEKLNYCGVAAS RKIAERDLQSMDRYKALIKKVGQKLCVDPAVIAGIIS RESHAGKALRNGWGDNGNGFGLMQVDRRSHKPV GEWNGERHLMQGTEILISMIKAIQKKFPRWTKEQQL KGGISAYNAGPGNVRSYERMDIGTTHDDYANDVVA RAQYYKQHGY |
| 610 Lysozyme G precursor (EC 3.2.1.17) (1,4-beta-N-acetylmuramidase) (Goose-type lysozyme) | *Gallus gallus* | 211 | MLGKNDPMCLVLVLLGLTALLGICQGGTGCYGSVS RIDTTGASCRTAKPEGLSYCGVRASRTIAERDLGSM NKYKVLIKRVGEALCIEPAVIAGIISRESHAGKILKNG WGDRGNGFGLMQVDKRYHKIEGTWNGEAHIRQGT RILIDMVKKIQRKPRWTRDQQLKGGISAYNAGVGN VRSYERMDIGTLHDDYSNDVVARAQYFKQHGY |
| 611 Lysozyme P precursor (EC 3.2.1.17) (1,4-beta-N-acetylmuramidase P) | *Drosophila melanogaster* | 141 | MKAFLVICALTLTAVATQARTMDRCSLAREMSKLGV PRDQLAKWTCIAQHESSFRTGVVGPANSNGSNDY GIFQINNKYWCKPADGRFSYNECGLSCNALLTDDIT NSVKCARKIQRQQGWTAWSTWKYCSGSLPSINSCF |
| 612 Lysozyme precursor | *Chlamys islandica* | 137 | MMYFVLLCLLATGTTYGAHNFATGIVPQSCLECICK TESGCRAIGCKFDVYSDSCGYFQLKQAYWEDCGR PGGSLTSCADDIHCSSQCVQHYMSRYIGHTSCSRT CESYARLHNGGPHGCEHGSTLGYWGHVQGHGC |
| 613 Lysozyme precursor (EC 3.2.1.17) (1,4-beta-N-acetylmuramidase) | *Bombyx mori* | 137 | MQKLIIFALVVLCVGSEAKTFTRCGLVHELRKHGFEE NLMRNWVCLVEHESSRDTSKTNTNRNGSKDYGLF QINDRYWCSKGASPGKDCNVKCSDLLTDDITKAAK CAKKIYKRHRFDAWYGWKNHCQGSLPDISSC |
| 614 Lysozyme precursor (EC 3.2.1.17) (1,4-beta-N-acetylmuramidase) | *Hyalophora cecropia* | 139 | MTKYVILLAVLAFALHCDAKRFTRCGLVQELRRLGF DETLMSNWVCLVENESGRFTDKIGKVNKNGSRDYG LFQINDKYWCSKGTTPGKDCNVTCNQLLTDDISVAA TCAKKIYKRHKFDAWYGWKNHCQHGLPDISDC |
| 615 Maculatin 1.1 [Contains: Maculatin 1.1.1] | *Litoria genimaculata* | 21 | GLFGVLAKVAAHVVPAIAEHF |
| 616 Maculatin 1.2 | *Litoria genimaculata* | 23 | GLFGVLAKVASHVVPAIAEHFQA |

TABLE 1-continued

| | | | |
|---|---|---|---|
| 617 Maculatin 2.1 | *Litoria genimaculata* | 18 | GFVDFLKKVAGTIANVVT |
| 618 Maculatin 3.1 | *Litoria genimaculata* | 26 | GLLQTIKEKLESLESLAKGIVSGIQA |
| 619 Magainins precursor | *Xenopus laevis* | 303 | MFKGLFICSLIAVICANALPQPEASADEDMDEREVR GIGKFLHSAGKFGKAFVGEIMKSKRDAEAVGPEAFA DEDLDEREVRGIGKFLHSAKKFGKAFVGEIMNSKRD AEAVGPEAFADEDLDEREVRGIGKFLHSAKKFGKAF VGEIMNSKRDAEAVGPEAFADEDLDEREVRGIGKFL HSAKKFGKAFVGEIMNSKRDAEAVGPEAFADEDFD EREVRGIGKFLHSAKKFGKAFVGEIMNSKRDAEAVG PEAFADEDLDEREVRGIGKFLHSAKKFGKAFVGEIM NSKRDAEAVDDRRWVE |
| 620 Melittin-like peptide (MLP) | *Rana temporaria* | 22 | FIGSALKVLAGVLPSIVSWVKQ |
| 621 Metchnikowin | *Drosophila melanogaster* | 52 | MQLNLGAIFLALLGVMATTTSVLAEPHRRQGPIFDT RPSPFNPNQPRPGPIY |
| 622 Metchnikowin precursor | *Drosophila melanogaster* | 52 | MQLNLGAIFLALLGVMATATSVLAEPHRHQGPIFDT RPSPFNPNQPRPGPIY |
| 623 MGD1 antimicrobial peptide (Fragment) | *Mytilus galloprovincialis* | 57 | CPNNYQCHRHCKSIPGRCGGYCGGWHRLRCTCYR CGGRREDVEDIFDIFDNEAADRF |
| 624 Misgurin | *Misgurnus anguillicaudatus* | 21 | RQRVEELSKFSKKGAAARRRK |
| 625 Moricin 1 precursor | *Bombyx mori* | 66 | MNILKFFFVFIVAMSLVSCSTAAPAKIPIKAIKTVGKA VGKGLRAINIASTANDVFNFLKPKKRKH |
| 626 Moricin 2 precursor | *Bombyx mori* | 66 | MNILKLFFVFIVAMSLVSCSTAAPAKIPIKAIKTVGKAV GKGLRAINIASTANDVFNFLKPKKRKH |
| 627 myeloid antimicrobial peptide 29 precursor | *Ovis aries* | 160 | METQRASLSLGRRSLWLLLLGLVLASARAQALSYRE AVLRAVDQLNEKSSEANLYRLLELDPPPKQDDENS NIPKPVSFRVKETVCPRTSQQPAEQCDFKENGLLKE CVGTVTLDQVGNNFDITCAEPQSVRGLRRLGRKIAH GVKKYGPTVLRIIRIAG |
| 628 Myeloid antimicrobial peptide precursor | *Ovis aries* | 165 | METQRAGLSLGRWSLRLLLLGLVLPSASTRSFSYRE AVLRAVDQFNERSAEANLYRLLELDPPPEQDAEDR GARKPVSFKVKETVCPRTSQQPVEQCDFRKNGLVK QCVGTVTRYWIRGDFDITCKDIQNVGLFGRLRDSLQ RGGQKILEKAERIGDRIKDIFRG |
| 629 Myticin A precursor | *Mytilus galloprovincialis* | 96 | MKATILLAVLVAVFVAGTEAHSHACTSYWCGKFCGT ASCTHYLCRVLHPGKMCACVHCSRVNNPFRVNQV AKSINDLDYTPIMKSMENLDNGMDML |
| 630 Myticin B precursor | *Mytilus galloprovincialis* | 96 | MKATMLLAVVVAVFVAGTEAHPHVCTSYYCSKFCG TAGCTRYGCRNLHRGKLCFCLHCSRVKFPFGATQD AKSMNELEYTPIMKSMENLDNGMDML |
| 631 Mytilin A | *Mytilus edulis* | 34 | GCASRCKAKCAGRRCKGWASASFRGRCYCKCFRC |
| 632 Mytilin B | *Mytilus edulis* | 34 | SCASRCKGHCRARRCGYYVSVLYRGRCYCKCLRC |
| 633 Mytilin B antimicrobial peptide precursor | *Mytilus galloprovincialis* | 103 | MKAAVILAIALVAILAVHEAEASCASRCKGHCRARRC GYYVSVLYRGRCYCKCLRCSSEHSMKFPENEGSS PSDMMPQMNENENTEFGQDMPTGETEQGETGI |
| 634 Mytimycin (Fragment) | *Mytilus edulis* | 33 | DCCRKPFRKHCWDCTAGTPYYGYSTRNIFGCTC |
| 635 Neutrophil antibiotic peptide NP-1 precursor (Neutrophil | *Rattus norvegicus* | 94 | MRTLTLLTALLLLALHTQAKSPQGTAEEAPDQEQLV MEDQDISISFGGDKGTALQDADVKAGVTCYCRRTR CGFRERLSGACGYRGRIYRLCCR |

TABLE 1-continued

| | | | |
|---|---|---|---|
| | defensin 1) (RatNP-1) | | |
| 636 | Neutrophil antibiotic peptide NP-2 precursor (Neutrophil defensin 2) (RatNP-2) | Rattus norvegicus | 94 | MRTLTLLTALLLLALHTQAKSPQGTAEEAPDQEQLV MEDQDISISFGGDKGTALQDADVKAGVTCYCRSTR CGFRERLSGACGYRGRIYRLCCR |
| 637 | Neutrophil antibiotic peptide NP-3 precursor (Neutrophil defensin 3) (RatNP-3a) | Rattus norvegicus | 87 | MRTLTLLTTLLLLALHTQAESPQGSTKEAPDEEQDIS VFFGGDKGTALQDAAVKAGVTCSCRTSSCRFGERL SGACRLNGRIYRLCC |
| 638 | Neutrophil antibiotic peptide NP-3 precursor (Neutrophil defensin 3) (RatNP-3b) | Rattus norvegicus | 87 | MRTLILLTTLLLLALHTQAESPQGSTKEAPDEEQDIS VFFGGDKGTALQDAAVKAGVTCSCRTSSCRFGERL SGACRLNGRIYRLCC |
| 639 | Neutrophil antibiotic peptide NP-4 precursor (Microbicidal peptide NP-4) | Oryctolagus cuniculus | 95 | MRTLALLAAILLVTLQAQAELHSGMADDGVDQQQP RAQDLDVAVYIKQDETSPLEVLGAKAGVSCTCRRFS CGFGERASGSCTVNGVRHTLCCRR |
| 640 | Neutrophil antibiotic peptide NP-4 precursor (Neutrophil defensin 4) (RatNP-4) | Rattus norvegicus | 93 | MRTLTLLITLLLLALHTQAESPQERAKAAPDQDMVM EDQDIFISFGGYKGTVLQDAVVKAGQACYCRIGACV SGERLTGACGLNGRIYRLCCR |
| 641 | Neutrophil antibiotic peptide NP-5 precursor (Microbicidal peptide NP-5) | Oryctolagus cuniculus | 95 | MRTLALLAAILLVTLQAQAELHSGMADDGVDQQQP RAQDLDVAVYIKQDETSPLEVLGAKAGVFCTCRGFL CGSGERASGSCTINGVRHTLCCRR |
| 642 | neutrophil beta-defensin 12 | Bos taurus | 60 | MRLHHLLLALLFLVLSAASGISGPLSCGRNGGVCIPI RCPVPMRQIGTCFGRPVKCCRSW |
| 643 | neutrophil beta-defensin 5 | Bos taurus | 54 | MRLHHLLLVLLFLVLSAGSGFTQVVRNPQSCRWNM GVCIPISCPGNMRQIGTCS |
| 644 | Neutrophil cationic antibacterial polypeptide of 11 kDa | Cavia porcellus | 178 | MGTPRDAASGGPRLLLPLLLLLLLTPATAWVLSYQQ AVQRAVDGINKNLADNENLFRLLSLDTQPPGDNDP YSPKPVSFTIKETVCTKMLQRPLEQCDFKENGLVQR CTGTVTLDSAFNVSSLSCLGGRRFRRMVGLRKKFR KTRKRIQKLGRKIGKTGRKVWKAWREYGQIPYPCRI |
| 645 | Neutrophil cationic peptide 1 precursor (Neutrophil defensin) (GPNP) (Corticostatic peptide GP-CS1) (CP-1) | Cavia porcellus | 93 | MRTVPLFAACLLLTLMAQAEPLPRAADHSDTKMKG DREDHVAVISFWEEESTSLEDAGAGRRCICTTRT CRFPYRRLGTCIFQNRVYTFCC |
| 646 | Neutrophil cationic peptide 1B precursor (Neutrophil defensin) (CP-1B) (GNCP) | Cavia porcellus | 93 | MRTVPLFAACLLLTLMAQAEPLPRAADHSDTKMKG DREDHVAVISFWEEESTSLQDAGAGRRCICTTR TCRFPYRRLGTCIFQNRVYTFCC |

TABLE 1-continued

| | | | |
|---|---|---|---|
| 647 Neutrophil cationic peptide 2 precursor (CP-2) (GNCP) (GNCP-2) | *Cavia porcellus* | 93 | MRTVPLFAACLLLTLMAQAEPLPRAADHSDTKMKG DREDHVAVISFWEEESTSLQDAGAGAGRRCICTTR TCRFPYRRLGTCLFQNRVYTFCC |
| 648 Neutrophil defensin 1 (HANP-1) | *Mesocricetus auratus* | 33 | VTCFCRRRGCASRERHIGYCRFGNTIYRLCCRR |
| 649 Neutrophil defensin 2 (HANP-2) | *Mesocricetus auratus* | 31 | CFCKRPVCDSGETQIGYCRLGNTFYRLCCRQ |
| 650 Neutrophil defensin 2 (RMAD-2) | *Macaca mulatta* | 30 | ACYCRIPACLAGERRYGTCFYMGRVWAFCC |
| 651 Neutrophil defensin 3 (HANP-3) | *Mesocricetus auratus* | 33 | VTCFCRRRGCASRERLIGYCRFGNTIYGLCCRR |
| 652 Neutrophil defensin 4 (HANP-4) | *Mesocricetus auratus* | 33 | VTCFCKRPVCDSGETQIGYCRLGNTFYRLCCRQ |
| 653 Neutrophil defensins 1, 3 and 8 precursor (RMAD) | *Macaca mulatta* | 96 | MRTLVILAAILLVALQAQAEPLQARTDEATAAQEQIP TDNPEVVVSLAWDESLAPKDSVPGLRKNMACYCRI PACLAGERRYGTCFYLGRVWAFCC |
| 654 Neutrophil defensins 4 and 5 precursor (RMAD) | *Macaca mulatta* | 94 | MRTIAILAAILLFALLAQAKSLQETADDMTQEQPGE DDQDLAVSFEENGLSTLRASGSQARRTCRCRFGR CFRRESYSGSCNINGRIFSLCCR |
| 655 Neutrophil defensins 6 and 7 precursor | *Macaca mulatta* | 94 | MRTIAILAAILLFALLAQAKSLQETADEMTQEQPGE DDQDLAVSFEENGLSTLRASGSQARRTCRCRFGR CFRRESYSGSCNINGRISSLCCR |
| 656 NK-lysin precursor (NKL) (Fragment) | *Sus scrofa* | 129 | PGLAFSGLTPEHSALARAHPCDGEQFCQNLAPEDP QGDQLLQREELGLICESCRKIIQKLEDMVGPQPNED TVTQAASRVCDKMKILRGVCKKIMRTFLRRISKDILT GKKPQAICVDIKICKEKTGLI |
| 657 Nonhistone chromosomal protein H6 (Histone T) [Contains: Oncorhyncin III] | *Oncorhynchus mykiss* | 69 | PKRKSATKGDEPARRSARLSARPVPKPAAKPKKAA APKKAVKGKKAAENGDAKAEAKVQAAGDGAGNAK |
| 658 Oligosaccharide-binding protein | *Bos taurus* | 190 | MSRRYTPLAWVLLALLGLGAAQDCGSIVSRGKWGA LASKCSQRLRQPVRYVVVSHTAGSVCNTPASCQR QAQNVQYYHVRERGWCDVGYNFLIGEDGLVYEGR GWNTLGAHSGPWNPIAIGISFMGNYMHRVPPASA LRAAQSLLACGAARGYLTPNYEVKGHRDVQQTLSP GDELYKIIQQWPHYRRV |
| 659 Opistoporin 1 | *Opistophthalmus carinatus* | 44 | GKVWDWIKSTAKKLWNSEPVKELKNTALNMKNLV AEKIGATPS |
| 660 Opistoporin 2 | *Opistophthalmus carinatus* | 44 | GKVWDWIKSTAKKLWNSEPVKELKNTALNAAKNFV AEKIGATPS |
| 661 Pandinin 1 | *Pandinus imperator* | 44 | GKVWDWIKSAAKKIWSSEPVSQLKGQVLNAAKNYV AEKIGATPT |
| 662 Pandinin 2 | *Pandinus imperator* | 24 | FWGALAKGALKLIPSLFSSFSKKD |
| 663 Parabutoporin | *Parabuthus schlechteri* | 45 | FKLGSFLKKAWKSKLAKKLRAKGKEMLKDYAKGLLE GGSEEVPGQ |
| 664 Penaeidin-1 (Pen-1) (P1) | *Litopenaeus vannamei* | 50 | YRGGYTGPIPRPPPIGRPPLRLVVCACYRLSVSDAR NCCIKFGSCCHLVK |
| 665 Penaeidin-2a precursor (Pen- | *Litopenaeus vannamei* | 72 | MRLVVCLVFLASFALVCQGEAYRGGYTGPIPRPPPI GRPPFRPVCNACYRLSVSDARNCCIKFGSCCHLVKG |

TABLE 1-continued

| | | | |
|---|---|---|---|
| 2a) (Pen-2) (P2) | | | |
| 666 Penaeidin-2b precursor (Pen-2b) | *Litopenaeus vannamei* | 72 | MRLVVCLVFLASFALVCQGEAYRGGYTGPIPRPPPI GRPPLRPVCNACYRLSVSDARNCCIKFGSCCHLVKG |
| 667 Penaeidin-2d precursor (Pen-2d) | *Litopenaeus setiferus* | 72 | MRLVVCLVFLASFALVCQGGAQRGGFTGPIPRPPP HGRPPLGPICNACYRLSFSDVRICCNFLGKCCHLVKG |
| 668 Penaeidin-3a precursor (Pen-3a) (P3-a) | *Litopenaeus vannamei* | 82 | MRLVVCLVFLASFALVCQGQVYKGGYTRPIPRPPPF VRPLPGGPIGPYNGCPVSCRGISFSQARSCCSRLG RCCHVGKGYSG |
| 669 Penaeidin-3b precursor (Pen-3b) (P3-b) | *Litopenaeus vannamei* | 82 | MRLVVCLVFLASFALVCQGQVYKGGYTRPVPRPPP FVRPLPGGPIGPYNGCPVSCRGISFSQARSCCSRL GRCCHVGKGYSG |
| 670 Penaeidin-3c precursor (Pen-3c) (P3-c) | *Litopenaeus vannamei* | 81 | MRLVVCLVFLASFALVCQGQVYKGGYTRPIPRPPFV RPVPGGPIGPYNGCPVSCRGISFSQARSCCSRLGR CCHVGKGYSG |
| 671 Penaeidin-3d precursor (Pen-3d) | *Litopenaeus vannamei* | 82 | MRLVVCLVFLASFALVCQGQVYKGGYTRPIPRPPPF VRPLPGGPIGPYNGCPISCRGISFSQARSCCSRLGR CCHVGKGYSG |
| 672 Penaeidin-3e precursor (Pen-3e) | *Litopenaeus vannamei* | 82 | MRLVVCLVFLAPFALVCHGQVYKGGYTRPIPRPPPF VRPLPGGPIGPYNGCPVSCRGISFSQARSCCSRLG RCCHVGKGYSG |
| 673 Penaeidin-3f precursor (Pen-3f) | *Litopenaeus vannamei* | 82 | MRLVACLVFLASFALVCQGQVYKGGYTRPIPRPPPF VRPLPGGPIGPYNGCPISCRGISFSQARSCCSRLGR CCHVGKGYSG |
| 674 Penaeidin-3g precursor (Pen-3g) | *Litopenaeus vannamei* | 82 | MRLVVCLVFLASFALVCQGQVYKGGYTRPIPRPPPF VRPLPGGPISPYNGCPVSCRGISFSQARSCCSRLG RCCHVGKGYSG |
| 675 Penaeidin-3h precursor (Pen-3h) | *Litopenaeus vannamei* | 82 | MRLVVCLVFLASFALVCQGQVYKGGYTRPIPRPPPF VRPLPGGPIGPYNGCPISCRGISFSQARSYCSRLGR CCHVGKGYSG |
| 676 Penaeidin-3i precursor (Pen-3i) | *Litopenaeus vannamei* | 82 | MRLVVCLVFLASFALVCQGQVYKGGYTRPIPRPPPF VRPLPGGPIGPYNGRPVSCRGISFSQARSCCSRLG RCCHVGKGYSG |
| 677 Penaeidin-3j precursor (Pen-3j) | *Litopenaeus vannamei* | 81 | MRLVVCLVFLASFALVCQGQVYKGGYTRPVPRPPF VRPLPGGPIGPYNGCPVSCRGISFSQARSCCSRLG RCCHVGKGYSG |
| 678 Penaeidin-3k precursor (Pen-3k) | *Litopenaeus setiferus* | 75 | MRLVVCLVFLASFALVCQGQGYKGPYTRPILRPYVR PVVSYNACTLSCRGITTTQARSCCTRLGRCCHVAK GYSG |
| 679 Penaeidin-3l precursor (Pen-3l) | *Litopenaeus setiferus* | 75 | MRLVVCLVFLASFALVCQGQGYKGPYTRPILRPYVR PVVSYNVCTLSCRGITTTQARSCCTRLGRCCHVAK GYSG |
| 680 Penaeidin-3m precursor (Pen-3m) | *Litopenaeus setiferus* | 75 | MRLVVCLVFLASFALVCQGQGCKGPYTRPILRPYVR PVVSYNACTLSCRGITTTQARSCCTRLGRCCHVAK GYSG |
| 681 Penaeidin-3n precursor (Pen-3n) | *Litopenaeus setiferus* | 75 | MRLVVCLVFLASFALVCQGQGYKGPYTRPILRPYVR PVVSYNACTLSCRGITTTQARSCSTRLGRCCHVAK GYSG |
| 682 Penaeidin-4a precursor (Pen-4a) | *Litopenaeus vannamei* | 67 | MRLVVCLVFLASFALVCQGHSSGYTRPLPKPSRPIFI RPIGCDVCYGIPSSTARLCCFRYGDCCHRG |
| 683 Penaeidin-4c precursor (Pen-4c) | *Litopenaeus vannamei* | 67 | MRLVVCLVFLASFALVCQGYSSGYTRPLPKPSRPIFI RPIGCDVCYGIPSSTARLCCFRYGDCCHRG |
| 684 Penaeidin-4d precursor (Pen-4d) | *Litopenaeus setiferus* | 67 | MRLLVCLVFLASFAMVCQGHSSGYTRPLRKPSRPIF IRPIGCDVCYGIPSSTARLCCFRYGDCCHLG |

TABLE 1-continued

| | | | | |
|---|---|---|---|---|
| 685 | Phormicin precursor (Insect defensins A and B) | Protophormia terraenovae | 94 | MKFFMVFVVTFCLAVCFVSQSLAIPADAANDAHFVD GVQALKEIEPELHGRYKRATCDLLSGTGINHSACAA HCLLRGNRGGYCNGKGVCVCRN |
| 686 | Phylloxin precursor | Phyllomedusa bicolor | 64 | MVFLKKSLLLVLFVGLVSLSICEENKREEHEEIEENK EKAEEKRGWMSKIASGIGTFLSGMQQG |
| 687 | Pleurocidin | Pseudopleuronectes americanus | 25 | GWGSFFKKAAHVGKHVGKAALHTYL |
| 688 | Pleurocidin 2 precursor | Pseudopleuronectes americanus | 68 | MKFTATFLMMAIFVLMVEPGECGWGSFFKKAAHVG KHVGKAALTHYLGDKQELNKRAVDEDPNVIVFE |
| 689 | Pleurocidin prepropolypeptide | Pseudopleuronectes americanus | 68 | MKFTATFLMIAIFVLMVEPGECGWGSFFKKAAHVGK HVGKAALTHYLGDKQELNKRAVDEDPNVIVFE |
| 690 | Pleurocidin prepropolypeptide | Pseudopleuronectes americanus | 68 | MKFTATFLMMFIFVLMVEPGECGWGSIFKHGRHAA KHIGHAAVNHYLGEQQDLDKRAVDEDPNVIVFE |
| 691 | Pleurocidin prepropolypeptide (Fragment) | Pseudopleuronectes americanus | 60 | MKFTATFLMIAIFVLMVEPGECGWGSFFKKAAHVGK HVGKAALTHYLGDKQELNKRAVDE |
| 692 | Pleurocidin prepropolypeptide (Fragment) | Pseudopleuronectes americanus | 60 | MKFTATFLMMFIFVLMVEPGECGWGSIFKHGRHAA KHIGHAAVNHYLGEQQDLDKRAVDE |
| 693 | Pleurocidin-like prepropolypeptide (Fragment) | Pseudopleuronectes americanus | 89 | MKFTATFLLLFIFVLMVDLGEGRRKKKGSKRKGSKG KGSKGKGRWLERIGKAGGIIIGGALDHLGQGQVQG PDYDYQEGEELNKRAVDE |
| 694 | Pleurocidin-like prepropolypeptide (Fragment) | Pseudopleuronectes americanus | 72 | MKFTATFLLLFIFVLMVDLGEGRRKRKWLRRIGKGV KIIGGAALDHLGQGQVQGQDYDYQEGQELNKRAVDE |
| 695 | Pleurocidin-like prepropolypeptide (Fragment) | Pseudopleuronectes americanus | 61 | MKFTATFLVLSLVVLMAEPGECFLGALIKGAIHGGRF IHGMIQNHHGYDEQQELNKRAVDE |
| 696 | Polyphemusin I | Limulus polyphemus | 18 | RRWCFRVCYRGFCYRKCR |
| 697 | Polyphemusin II | Limulus polyphemus | 18 | RRWCFRVCYKGFCYRKCR |
| 698 | Ponericin G1 | Pachycondyla goeldii | 30 | GWKDWAKKAGGWLKKKGPGMAKAALKAAMQ |
| 699 | Ponericin G2 | Pachycondyla goeldii | 30 | GWKDWLKKGKEWLKAKGPGIVKAALQAATQ |
| 700 | Ponericin G3 | Pachycondyla goeldii | 30 | GWKDWLNKGKEWLKKKGPGIMKAALKAATQ |
| 701 | Ponericin G4 | Pachycondyla goeldii | 29 | DFKDWMKTAGEWLKKKGPGILKAAMAAAT |
| 702 | Ponericin G5 | Pachycondyla goeldii | 30 | GLKDWVKIAGGWLKKKGPGILKAAMAAATQ |
| 703 | Ponericin G6 | Pachycondyla goeldii | 18 | GLVDVLGKVGGLIKKLLP |
| 704 | Ponericin G7 | Pachycondyla goeldii | 19 | GLVDVLGKVGGLIKKLLPG |
| 705 | Ponericin L1 | Pachycondyla goeldii | 24 | LLKELWTKMKGAGKAVLGKIKGLL |
| 706 | Ponericin L2 | Pachycondyla goeldii | 24 | LLKELWTKIKGAGKAVLGKIKGLL |

TABLE 1-continued

| 707 | Ponericin W1 | Pachycondyla goeldii | 25 | WLGSALKIGAKLLPSVVGLFKKKKQ |
|---|---|---|---|---|
| 708 | Ponericin W2 | Pachycondyla goeldii | 25 | WLGSALKIGAKLLPSVVGLFQKKKK |
| 709 | Ponericin W3 | Pachycondyla goeldii | 26 | GIWGTLAKIGIKAVPRVISMLKKKKQ |
| 710 | Ponericin W4 | Pachycondyla goeldii | 26 | GIWGTALKWGVKLLPKLVGMAQTKKQ |
| 711 | Ponericin W5 | Pachycondyla goeldii | 24 | FWGALIKGAAKLIPSVVGLFKKKQ |
| 712 | Ponericin W6 | Pachycondyla goeldii | 20 | FIGTALGIASAIPAIVKLFK |
| 713 | Preprodefensin | Boophilus microplus | 74 | MRGIYICLXFVLXCGLVSGLADVPAESEMAHLRVRR GFGCPFNQGACHRHCRSIRRRGGYCAGLIKQTCTC YRN |
| 714 | preprodefensin | Ixodes ricinus | 76 | MKVLAVSLAFLLIAGLISTSLAQNEEGGEKELVRVRR GGYYCPFFQDKCHRHCRSFGRKAGYCGGFLKKTCI CVMK |
| 715 | Probable antibacterial peptide polyprotein precursor | Riptortus clavatus | 678 | MRSPRVIHLACVIAYIVAVEAGDKPVYLPRPTPPRPI HPRLAREVGWELEGQGLSPLSEAELLPEVRERRSP VDKGGYLPRPTPPRPVYRSRRDASLESELSPLSVA EVLPEVRERRSPVDKGGYLPRPTPPRPVYRSRRDA SLESELSPLSEAEVLPEVRERRSPVDKGGYLPRPTP PRPVYRSRRVASLESELSPLSEAEVLPEVRERRSPV DKGGYLPRPTPPRPVYRSRRDASLESELSPLSEEE VLPEVRERGSPVDKGGYLPRPTPPRPVYRSRRDAS LESELSPLSVAEDLPEVRERRSPVDKGGYLPRPTPP RPVYRSRRDASLESELSPLSEAEVLPEVRERRSPV DKGGYLPRPTPPRPVYRSRRDASLESELSPLSEAE VLPEVRERRSPVDKGGYLPRPTPPRPVYRSRRDAS LESELSPLSEAEVLPEVRERRSPVDKGGYLPRPTPP RPVYRSRRDASLESELSPLSEAEVLPEVRERRSPV DKGGYLPRPTPPRPVYRSRRDATLESELSPSSEAE VLPEVRERRSPVDKGGYLPRPTPPRPVYRSRRDAS LESELSPLSEAEVLPEVRERRSPVDKGGYLPRPTPP RPVYRSRRDASLESELSPLSEAEGLPEVRERRSPG GQGGYLPRPTPRTPLCRSRRDANLDAEQSPVSEG VVLPEVR |
| 716 | Probable antibacterial peptide precursor | Riptortus clavatus | 150 | MHIARFCLLSSMAVLALSAGYVSGAVIEIPDEILDSA RFISLYSDGLRQKRQLNLSGPGSEHAGTIRLDGQRN IFDNGRTRVDGTGSYQLDYARGMKPIHGAGLGAEV NHNIWRGRGGQSLDLYGGATRQFNFGNRPNEWG AHGGIRYNF |
| 717 | Proenkephalin A precursor [Contains: Synenkephalin; Met-enkephalin (Opioid growth factor) (OGF); Met-enkephalin-Arg-Gly-Leu; Leu-enkephalin; Enkelytin; Met-enkephalin-Arg-Phe] | Bos taurus | 263 | MARFLGLCTWLLALGPGLLATVRAECSQDCATCSY RLARPTDLNPLACTLECEGKLPSLKTWETCKELLQL TKLELPPDATSALSKQEESHLLAKKYGGFMKRYGG FMKKMDELYPLEVEEEANGGEVLGKRYGGFMKKD AEEDDGLGNSSNLLKELLGAGDQREGSLHQEGSDA EDVSKRYGGFMRGLKRSPHLEDETKELQKRYGGF MRRVGRPEWWMDYQKRYGGFLKRFAEPLPSEEE GESYSKEVPEMEKRYGGFMRF |
| 718 | Prophenin-1 precursor (PF-1) (C6) (Fragment) | Sus scrofa | 212 | LLLLALVVPSASAQALSYREAVLRAVDRLNEQSSEA NLYRLLELDQPPKADEDPGTPKPVSFTVKETVCPRP TRQPPELCDFKENGRVKQCVGTVTLDQIKDPLDITC NEGVRRFPWWWPFLRRPRLRRQAFPPPNVPGPRF PPPNFPGPRFPPPNFPGPRFPPPNFPGPRFPPPNF PGPPFPPPIFPGPWFPPPPPFRPPPPFGPPRFPGRR |
| 719 | Prophenin-2 precursor (PF-2) (PR-2) (C12) | Sus scrofa | 228 | METQRASLCLGRWSLWLLLLALVVPSASAQALSYR EAVLRAVDRLNEQSSEANLYRLLELDQPPKADEDP GTPKPVSFTVKETVCPRPTRRPPELCDFKENGRVK |

TABLE 1-continued

| | | | |
|---|---|---|---|
| (Prophenin-1 like) | | | QCVGTVTLDQIKDPLDITCNEGVRRFPWWWPFLRR PRLRRQAFPPPNVPGPRFPPPNVPGPRFPPPNFPG PRFPPPNFPGPRFPPPNFPGPPFPPPIFPGPWFPP PPPFRPPPFGPPRFPGRR |
| 720 Protegrin 1 precursor (PG-1) (Neutrophil peptide 1) | Sus scrofa | 149 | METQRASLCLGRWSLWLLLLALVVPSASAQALSYR EAVLRAVDRLNEQSSEANLYRLLELDQPPKADEDP GTPKPVSFTVKETVCPRPTRQPPELCDFKENGRVK QCVGTVTLDQIKDPLDITCNEVQGVRGGRLCYCRR RFCVCVGRG |
| 721 Protegrin 2 precursor (PG-2) | Sus scrofa | 147 | METQRASLCLGRWSLWLLLLALVVPSASAQALSYR EAVLRAVDRLNEQSSEANLYRLLELDQPPKADEDP GTPKPVSFTVKETVCPRPTRQPPELCDFKENGRVK QCVGTVTLDQIKDPLDITCNEVQGVRGGRLCYCRR RFCICVG |
| 722 Protegrin 3 precursor (PG-3) | Sus scrofa | 149 | METQRASLCLGRWSLWLLLLALVVPSASAQALSYR EAVLRAVDRLNEQSSEANLYRLLELDQPPKADEDP GTPKPVSFTVKETVCPRPTRQPPELCDFKENGRVK QCVGTVTLDQIKDPLDITCNEVQGVRGGGLCYCRR RFCVCVGRG |
| 723 Protegrin 4 precursor (PG-4) | Sus scrofa | 149 | METQRASLCLGRWSLWLLLLALVVPSASAQALSYR EAVLRAVDRLNEQSSEANLYRLLELDQPPKADEDP GTPKPVSFTVKETVCPRPTRQPPELCDFKENGRVK QCVGTVTLDQIKDPLDITCNEVQGVRGGRLCYCRG WICFCVGRG |
| 724 Protegrin 5 precursor (PG-5) | Sus scrofa | 149 | METQRASLCLGRWSLWLLLLGLVVPSASAQALSYR EAVLRAVDRLNEQSSEANLYRLLELDQPPKADEDP GTPKPVSFTVKETVCPRPTRQPPELCDFKENGRVK QCVGTVTLDQIKDPLDITCNEVQGVRGGRLCYCRP RFCVCVGRG |
| 725 Protegrin-1 | Sus scrofa | 19 | RGGRLCYCRRRFCVCVGRX |
| 726 Pseudin 1 | Pseudis paradoxa | 24 | GLNTLKKVFQGLHEAIKLINNHVQ |
| 727 Pseudin 2 | Pseudis paradoxa | 24 | GLNALKKVFQGIHEAIKLINNHVQ |
| 728 Pseudin 3 | Pseudis paradoxa | 23 | GINTLKKVIQGLHEVIKLVSNHE |
| 729 Pseudin 4 | Pseudis paradoxa | 23 | GINTLKKVIQGLHEVIKLVSNHA |
| 730 Putative antimicrobial peptide | Litopenaeus setiferus | 188 | MKGIKAVILCGLFTAVLAGKYRGFGQPLGGLGVPGG GVGVGVGGGLGGGLGGGLGGGLGGGLGGGLGGL GGGLGGLGGGLGGGLGGGLGGGLGGSHGT SDCRYWCKTPEGQAYCCESAHEPETPVGTKPLDC PQVRPTCPRFHGPPTTCSNDYKCAGLDKCCFDRCL GEHVCKPPSFFGQQIFG |
| 731 Putative antimicrobial peptide | Litopenaeus setiferus | 123 | MKGLGVILCCVLAVVPAHAGPGGFPGGVPGRFPSA TAPPATCRRWCKTPENQAYCCETIFEPEAPVGTKP LDCPQVRPTCPRFHGPPVTCSSDYKCGGVDKCCF DRCLGEHVCKPPSFYSQFP |
| 732 Putative antimicrobial peptide | Litopenaeus setiferus | 141 | MKGLGVILCCVLAVVPAHAGPGGFSGGVPGGFPG GRPGGFPGGVPGGFPSATAPPATCRRWCKTPENQ AYCCETIFEPEAPVGTKPLDCPQVRPTCPPTRFGG RPVTCSSDYKCGGLDKCCFDRCLGEHVCKPPSFYS QFR |
| 733 Putative antimicrobial peptide | Litopenaeus vannamei | 163 | MKGIKAVILCGLFTAVLAGKFRGFGQPFGGLGGPG GGVGVGGGFPGGGLGVGGGLGVGGGLGVGGGLG VGGGLGTGTSDCRYWCKTPEGQAYCCESAHEPET PVGTKILDCPQVRPTCPRFHGPPTTCSNDYKCAGL DKCCFDRCLGEHVCKPPSFFGSQVFG |
| 734 Putative antimicrobial peptide | Litopenaeus vannamei | 163 | MKGIKAVILCGLFTAVLAGKFRGFGQPFGGLGGPG GGVGVGGGFPGGGLGVGGGLGVGGGLGVGGGLG VGGGLGTGTSDCRYWCKTPEGQAYCCESAHEPET PVGTKPLDCPQVRPTCPRFHGPPTTCSNDYKCAGL DKCCFDRCLGEHVCKPPSFFGSQVFG |

TABLE 1-continued

| | | | | |
|---|---|---|---|---|
| 735 | Putative antimicrobial peptide | Litopenaeus vannamei | 169 | MKGIKAVILCGLFTAVLAGKFRGFGQPFGGLGGPG GGVGVGGGFPGGGLGVGGGLGVGGGLGVGGGLG VGGGLGVGGGLGTGTSDCRYWCKTPEGQAYCCE SAHEPETPVGTKILDCPQVRPTCPRFHGPPTTCSN DYKCAGLDKCCFDRCLGEHVCKPPSFFGSQVFG |
| 736 | Putative antimicrobial peptide | Litopenaeus vannamei | 163 | MKGIKAVILCGLFTAVLAGKFRGFGQPFGGLGGPG GSVGVGGGFPGGGLGVGGGLGVGGGLGVGGGLG VGGGLGTGTSDCRYWCKTPEGQAYCCESAHEPET PVGTKPLDCPQVRPTCPRFHGPPTTCSNDYKCAGL DKCCFDRCLGEHVCKPPSFFGSQVFG |
| 737 | Putative antimicrobial peptide | Litopenaeus vannamei | 151 | MKGIKAVILCGLFTAVLAGKFRGFGRPFGGLGGPG GGVGVGGGFPGGGLGVGGGLGVGGGLGTGTSDC RYWCKTPEGQAYCCESAHEPETPVGTKPLDCPQV RPTCPRFHGPPTTCSNDYKCAGLDKCCFDRCLGEH VCKPPSFFGSQVFG |
| 738 | Putative antimicrobial peptide | Litopenaeus vannamei | 163 | MKGIKAVILCGLFTAVLAGKFRGFGRPFGGLGGPG GGVGVGGGFPGGGLGVGGGLGVGGGLGVGGGLG VGGGLGTGTSDYRYWCKTPEGQAYCCESAHEPET PVGTKPLDCPQVRPTCPRFHGPPTTCSNDYKCAGL DKCCFDRCLGEHVCKPPSFFGSQVFG |
| 739 | Putative beta defensin | Mus musculus | 79 | MKTFLFLFAVLFFLDPAKNAFFDEKCSRVNGRCTAS CLKNEELVALCQKNLKCCVTVQPCGKSKSNQSDEG SGHMGTWG |
| 740 | Putative beta defensin | Mus musculus | 63 | MPQTFFVFCFLFFVFLQLFPGTGEIAVCETCRLGRG KCRRACIESEKIVGWCKLNFFCCRERI |
| 741 | Putative beta defensin | Mus musculus | 64 | MRIFSLIVAGLVLLIQLYPAWGTLYRRFLCKKMNGQ CEAECFTFEQKIGTCQANFLCCRKRKEH |
| 742 | Putative beta defensin | Mus musculus | 67 | MRTLCSLLLICCLLFSYTTPAANSIIGVSEMERCHKK GGYCYFYCFSSHKKIGSCFPEWPRCCKNIK |
| 743 | Putative beta defensin | Mus musculus | 77 | MRTLCSLLLICCLLFSYTTPAVGDLKHLILKAQLARC YKFGGFCYNSMCPPHTKFIGNCHPDHLHCCINMKE LEGST |
| 744 | Putative beta defensin | Mus musculus | 73 | MRTLCSLLLICCLLFSYTTPAVGDLKHLILKAQLTRCY KFGGFCHYNICPGNSRFMSNCHPENLRCCKNIKQF |
| 745 | Putative potassium channel blocker TXKs2 | Mesobuthus martensii | 61 | MTYAILIIVSLLLISDRISNVVDKYCSENPLDCNEHCL KTKNQIGICHGANGNEKCSCMES |
| 746 | PYLa/PGLa precursor | Xenopus laevis | 64 | MYKQIFLCLIIAALCATIMAEASAFADADEDDDKRYV RGMASKAGAIAGKIAKVALKALGRRDS |
| 747 | Pyrrhocoricin | Pyrrhocoris apterus | 20 | VDKGSYLPRPTPPRPIYNRN |
| 748 | Ranalexin precursor | Rana catesbeiana | 66 | MFTLKKSLLLLFFLGTINLSLCEEERNAEEERRDNPD ERDVEVEKRFLGGLIKIVPAMICAVTKKC |
| 749 | Ranalexin-1CA | Rana clamitans | 20 | FLGGLMKAFPALICAVTKKC |
| 750 | Ranalexin-1CB | Rana clamitans | 20 | FLGGLMKAFPAIICAVTKKC |
| 751 | Ranatuerin-1C | Rana clamitans | 25 | SMLSVLKNLGKVGLGLVACKINKQC |
| 752 | RANATUERIN-2B | Rana berlandieri | 28 | GLLDTIKGVAKTVAASMLDKLKCKISGC |
| 753 | Ranatuerin-2CA | Rana clamitans | 31 | GLFLDTLKGAAKDVAGKLLEGLKCKIAGCKP |
| 754 | Ranatuerin-2CB | Rana clamitans | 27 | GLFLDTLKGLAGKLLQGLKCIKAGCKP |
| 755 | RANATUERIN-2LB | Rana luteiventris | 32 | GILSSIKGVAKGVAKNVAAQLLDTLKCKITGC |

TABLE 1-continued

| | | | |
|---|---|---|---|
| 756 RANATUERIN-2P | Rana pipiens | 27 | LMDTVKNVAKNLAGHMLDKLKCKITGC |
| 757 RANATUREIN-2LA | Rana luteiventris | 32 | GILDSFKGVAKGVAKDLAGKLLDKLKCKITGC |
| 758 Rhinocerosin precursor | Oryctes rhinoceros | 142 | MMKLYIVFGFIAFSAAYVVPEGYYEPEYYPADGYES ERVARASPAELIFDEDLADEPEVEEPQYYIRTRRSL QPGAPNFPMPGSQLPTSITSNIEKQGPNTAATINAQ HKTDRYDVGATWSKVIRGPGRSKPNWSIGGTYRW |
| 759 Royalisin precursor (Defensin) | Apis mellifera | 95 | MKIYFIVGLLFMAMVAIMAAPVEDEFEPLEHFENEER ADRHRRVTCDLLSFKGQVNDSACAANCLSLGKAGG HCEKVGCICRKTSFKDLWDKRFG |
| 760 Rugosin A | Rana rugosa | 33 | GLLNTFKDWAISIAKGAGKGVLTTLSCKLDKSC |
| 761 Rugosin B | Rana rugosa | 33 | SLFSLIKAGAKFLGKNLLKQGAQYAACKVSKEC |
| 762 Rugosin C | Rana rugosa | 37 | GILDSFKQFAKGVGKDLIKGAAQGVLSTMSCKLAKTC |
| 763 Sapecin B precursor | Sarcophaga peregrina | 88 | MKFLTSLLLLFVVVMVSAVNLSMAKESANQLTERLQ ELDGAAIQEPAELNRHKRLTCEIDRSLCLLHCRLKG YLRAYCSQQKVCRCVQ |
| 764 Sapecin C | Sarcophaga peregrina | 40 | ATCDLLSGIGVQHSACALHCVFRGNRGGYCTGKGI CVCRN |
| 765 Sapecin precursor | Sarcophaga peregrina | 94 | MKSFIVLAVTLCLAAFFMGQSVASPAAAAEESKFVD GLHALKTIEPELHGRYKRATCDLLSGTGINHSACAA HCLLRGNRGGYCNGKAVCVCRN |
| 766 Sarcotoxin IA precursor | Sarcophaga peregrina | 63 | MNFQNIFIFVALILAVFAGQSQAGWLKKIGKKIERVG QHTRDATIQGLGIAQQAANVAATARG |
| 767 Sarcotoxin IB precursor | Sarcophaga peregrina | 63 | MNFNKVFIFVALILAVFAGQSQAGWLKKIGKKIERVG QHTRDATIQVIGVAQQAANVAATARG |
| 768 Sarcotoxin IC | Sarcophaga peregrina | 39 | GWLRKIGKKIERVGQHTRDATIQVLGIAQQAANVAA TAR |
| 769 Sarcotoxin ID | Sarcophaga peregrina | 40 | GWIRDFGKRIERVGQHTRDATIQTIAVAQQAANVAA TLKG |
| 770 Sarcotoxin II-1 precursor | Sarcophaga peregrina | 26 | MKSFVLFAACMAIIALGSLAHAYPQKLPVPIPPPSNP PVAVLQNSVATNSKGGQDVSVKLSATNLGNNHVQP IAEVFAEGNTKGGNVLRGATVGVQGHGLGASVTKT QTDTKIKGLDFQPQLSSSTLALQGDRLGASISRDVN RGVSDTFTKSVSANVFRNDNHNLDATVFRSDVRQN NGFNFQKTGGMLDYSHANGHGLNAGLTHFSGIGN QANVGGSSTLFKSNDGSLSLKANAGGSQWLSGPF SNQRDYNVGLSLTHHGCGG |
| 771 Sarcotoxin II-2 precursor | Sarcophaga peregrina | 294 | MKSFVFFAACFAIVALNSLAHAYPQKLPVPIPPPTNP PVAAFHNSVATNSKGGQDVSVKLAATNLGNKHVQP IAEVFAKGNTQGGNVLRGATVGVQGHGLGASVTKT QDGIAESFRKQAEANLRLGDSASLIGKVSQTDTKIK GIDFKPQLSSSSLALQGDRLGASISRDVNRGVSDTL TKSISANVFRNDNHNLDASVFRSDVRQNNGFNFQK TGGMLDYSHANGHGLNAGLTRFSGIGNQANVGGY STLFRSNDGLTSLKANAGGSQWLSGPFANQRDYSF GLGLSHNAWRG |
| 772 Sarcotoxin II-3 precursor | Sarcophaga peregrina | 294 | MKSFVLFAACMAIVALSSLAHAYPQKLPVPIPPPTNP PVAAFHNSVATNSKGGQDVSVKLAATNLGNKHVQP IAEVFAEGNTKGGNVIRGATVGVQGHGLGASVTKS GNGIAESFRKQAEANLRLGDSASLIGKVSQTDTKIK GIDFKPQLSSSSLALQGDRLGASISRDVNRGVSDTL TKSISANVFRNDNHNLDASVFRSDVRQNNGFNFQK TGGMLDYSHANGHGLNAGLTRFSGIGNQANVGGY STLFRSNDGLTSLKANAGGSQWLSGPFANQRDYSF GLGLSHNAWRG |
| 773 Sarcotoxin IIA precursor | Sarcophaga peregrina | 294 | MKSFVFFAACMAIIALSSLVQAYPQKLPVPIPPPTNP PVAAFHNSVATNSKGGQDVSVKLAATNLGNKHVQP IAEVFAEGNTKGGNVLRGATVGVQGHGLGASVTKS |

TABLE 1-continued

| | | | |
|---|---|---|---|
| | | | QDGIAESFRKQAEANLRLGDSASLIGKVSQTDTKIK GIDFKPQLSSSSLALQGDRLGASISRDVNRGVSDTL TKSVSANLFRNDNHNLDASVFRSDVRQNNGFNFQK TGGMLDYSHANGHGLNAGLTRFSGIGNQATVGGY STLFRSNDGLTSLKANAGGSQWLSGPFANQRDYSF GLGLSHNAWRG |
| 774 Scorpine precursor | Pandinus imperator | 94 | MNSKLTALIFLGLIAIAYCGWINEEKIQKKIDERMGNT VLGGMAKAIVHKMAKNEFQCMANMDMLGNCEKHC QTSGEKGYCHGTKCKCGTPLSY |
| 775 Secretogranin I precursor (SgI) (Chromogranin B) (CgB) [Contains: GAWK peptide; Secretolytin] | Bos taurus | 646 | MQPAALLGLLGATVVAAVSSMPVDIRNHNEEVVTH CIIEVLSNALLKSSAPPITPECRQVLKKNGKELKNEE KSENENTRFEVRLLRDPADTSEAPGLSSREDSGEG DAQVPTVADTESGGHSRERAGEPPGSQVAKEAKT RYSKSEGQNREEEMVKYQKRERGEVGSEERLSEG PGKAQTAFLNQRNQTPAKKEELVSRYDTQSARGLE KSHSRERSSQESGEETKSQENWPQELRHPEGQE APGESEEDASPEVDKRHSRPRHHHGRSRPDRSSQ EGNPPLEEESHVGTGNSDEEKARHPAHFRALEEGA EYGEEVRRHSAAQAPGDLQGARFGGRGRGEHQAL RRPSEESLEQENKRHGLSPDLNMAQGYSEESEEE RGPAPGPSYRARGGEAAAYSTLGQTDEKRFLGETH HRVQESQRDKARRRLPGELRNYLDYGEEKGEEAA RGKWQPQGDPRDADENREEARLRGKQYAPHHITE KRLGELLNPFYDPSQWKSSRFERKDPMDDSFLEGE EENGLTLNEKNFFPEYNYDWWEKKPFEEDVNWGY EKRNPVPKLDLKRQYDRVAELDQLLHYRKKSAEFP DFYDSEEQMSPQHTAENEEEKAGQGVLTEEEEKEL ENLAAMDLELQKIAEKFSGTRRG |
| 776 Similar to cryptdin-4 | Mus musculus | 93 | MKKLVLLSALVLLAYQVQTDPIQNTDEETNTEEQPG EEDQAVSVSFGGQEGSALHEKLSRDLICLCRKRRC NRGELFYGTCAGPFLRCCRRRR |
| 777 Similar to cryptdin-4 | Mus musculus | 93 | MKTLVLLSALILLAYQVQTDPIQNTDEETNTEEQPGE DDQAVSVSFGGQEGSALHEKLSRDLICLCRNRRCN RGELFYGTCAGPFLRCCRRRR |
| 778 Similar to cryptdin-4 | Mus musculus | 95 | MKTLVLLSALVLLAFQVQADPIQNTDEETNTEEQAG EEDQAVSVSFGDPEGSALHEKSSRDLICYCRKGGC NRGEQVYGTCSGRLLFCCRRRHRH |
| 779 Similar to cryptdin-4 | Mus musculus | 95 | MKTLVLLSALVLLAFQVQADPIQNTDEETNTEEQAG EEDQAVSVSFGDPEGSALHEKSSRDLICYCRKGGC NRGEQVYGTCSGRLLLCCRRRHRH |
| 780 Similar to cryptdin-4 | Mus musculus | 95 | MKTLVLLSALVLLAFQVQADPIQNTDEETNTEEQPG EEDQAVSVSFGDPEGSALHEKSSRDLICYCRKGGC NRGEQVYGTCSGRLLFCCRRRHRH |
| 781 Single WAP motif protein 1 precursor (Elafin-like protein I) | Mus musculus | 80 | MKLLGLSLLAVTILLCCNMARPEIKKKNVFSKPGYCP EYRVPCPFVLIPKCRRDKGCKDALKCCFFYCQMRC VDPWESPE |
| 782 Single WAP motif protein 2 precursor (Elafin-like protein II) | Mus musculus | 85 | MWPNSILVLMTLLISSTLVTGGGVKGEEKRVCPPDY VRCIRQDDPQCYSDNDCGDQEICCFWQCGFKCVL PVKDNSEEQIPQSKV |
| 783 Spingerin | Pseudacan thotermes spiniger | 25 | HVDKKVADKVLLLKQLRIMRLLTRL |
| 784 Styelin A (Fragment) | Styela clava | 20 | GXFGKAFXSVSNFAKKHKTA |
| 785 Styelin B (Fragment) | Styela clava | 20 | GXFGPAFHSVSNFAKKHKTA |
| 786 Styelin C precursor | Styela clava | 80 | MQMKATILIVLVALFMIQQSEAGWFGKAFRSVSNFY KKHKTYIHAGLSAATLLGDMTDEEFQEFMQDIEQAR EEELLSRQ |

TABLE 1-continued

| | | | |
|---|---|---|---|
| 787 Styelin D precursor | Styela clava | 81 | MQMKATILIVLVALFMIQQSEAGWLRKAAKSVGKFY YKHKYYIKAAWQIGKHALGDMTDEEFQDFMKEVEQ AREEELQSRQ |
| 788 Styelin E precursor | Styela clava | 81 | MQMKATILIVLVALFMIQQSEAGWLRKAAKSVGKFY YKHKYYIKAAWKIGRHALGDMTDEEFQDFMKEVEQ AREEELQSRQ |
| 789 T22H6.7 protein (ABF-6) | Caenorhabditis elegans | 195 | MFRKLIIATFVLSLCDLANSVTICSSSSLLSTFTDPLC TSWCKVRFCSSGSCRSVMSGSDPTCECESCGFGS WFGSSSDSNSNQPVSGQYYAGGSGGEMATPNYG NNNGYNNGYNNGNNMRYNDNNGYNTNNGYRGQP TPGYGNSNSNFNSNQQYSYQQYYNNRNNQYGNS GYGNAGQAGQTGYPSGYQNLKKKR |
| 790 tachycitin precursor | Tachypleus tridentatus | 98 | MASSFMFAVVVLFISLAANVESYLAFRCGRYSPCLD DGPNVNLYSCCSFYNCHKCLARLENCPKGLHYNAY LKVCDWPSKAGCTSVNKECHLWKTGRK |
| 791 Tachyplesin I precursor | Tachypleus tridentatus | 77 | MKKLVIALCLMMVLAVMVEEAEAKWCFRVCYRGIC YRRCRGKRNEVRQYRDRGYDVRAIPEETFFTRQDE DEDDDEE |
| 792 Tachyplesin II precursor | Tachypleus tridentatus | 77 | MKKLVIALCLMMVLAVMVEEAEARWCFRVCYRGIC YRKCRGKRNEVRQYRDRGYDVRAIPDETFFTRQDE DEDDDEE |
| 793 Tachystatin A2 precursor | Tachypleus tridentatus | 67 | MKLQNTLILIGCLFLMGAMIGDAYSRCQLQGFNCVV RSYGLPTIPCCRGLTCRSYFPGSTYGRCQRY |
| 794 Temporin A | Rana temporaria | 13 | FLPLIGRVLSGIL |
| 795 Temporin B precursor | Rana temporaria | 61 | MFTLKKSLLLLFFLGTINLSLCEEERNAEEERRDEPD ERDVQVEKRLLPIVGNLLKSLLGK |
| 796 Temporin C | Rana temporaria | 13 | LLPILGNLLNGLL |
| 797 Temporin D | Rana temporaria | 13 | LLPIVGNLLNSLL |
| 798 Temporin E | Rana temporaria | 13 | VLPIIGNLLNSLL |
| 799 Temporin F | Rana temporaria | 13 | FLPLIGKVLSGIL |
| 800 Temporin G precursor | Rana temporaria | 61 | MFTLKKSLLLLFFLGTINLSLCEEERDADEERRDDLE ERDVEVEKRFFPVIGRILNGILGK |
| 801 Temporin H precursor | Rana temporaria | 58 | MFTLKKSLLLLFFLGTINLSLCEEERNAEEERRDEPD ERDVQVEKRLSPNLLKSLLGK |
| 802 Temporin K | Rana temporaria | 10 | LLPNLLKSLL |
| 803 Temporin L | Rana temporaria | 13 | FVQWFSKFLGRIL |
| 804 Temporin-1CA | Rana clamitans | 13 | FLPFLAKILTGVL |
| 805 Temporin-1CB | Rana clamitans | 13 | FLPFASLIGKLL |
| 806 Temporin-1CC | Rana clamitans | 13 | FLPFASLLTKVL |
| 807 Temporin-1CD | Rana clamitans | 13 | FLPFASLLSKVL |
| 808 Temporin-1CE | Rana clamitans | 13 | FLPFLATLLSKVL |
| 809 Temporin-1Ja | Rana japonica | 13 | ILPLVGNLLNDLL |

| | | | |
|---|---|---|---|
| 810 Temporin-1LA | Rana luteiventris | 13 | VLPLISMALGKLL |
| 811 Temporin-1LB | Rana luteiventris | 14 | NFLGTLINLAKKIM |
| 812 Temporin-1LC | Rana luteiventris | 14 | FLPILINLIHKGLL |
| 813 Temporin-1P | Rana pipiens | 13 | FLPIVGKLLSGLL |
| 814 Tenecin 1 precursor | Tenebrio molitor | 84 | MKLTIFALVACFFILQIAAFPLEEAATAEEIEQGEHIRV KRVTCDILSVEAKGVKLNDAACAAHCLFRGRSGGY CNGKRVCVCR |
| 815 Tenecin 3 precursor | Tenebrio molitor | 96 | MKTFVICLILVVAVSAAPDHHDGHLGGHQTGHQGG QQGGHLGGQQGGHLGGHQGGQPGGHLGGHQGG IGGTGGQQHGQHGPGTGAGHQGGYKTHGH |
| 816 Termicin | Pseudacanthotermes spiniger | 36 | ACNFQSCWATCQAQHSIYFRRAFCDRSQCKCVFV RG |
| 817 Testis defensin (Fragment) | Mus musculus | 41 | MKTLVLLSALFLLAFQVQADPIQNTDEETNTEVQPQ EEDQA |
| 818 Testis defensin (Fragment) | Mus musculus | 40 | MKTLVLLSPSSCWPSRSRLILSKTQMKRLKLRSSQR KRTR |
| 819 Testis-specific beta-defensin-like protein | Mus musculus | 83 | MRLALLLLAILVATELVVSGKNPILQCMGNRGFCRS SCKKSEQAYFYCRTFQMCCLQSYVRISLTGVDDNT NWSYEKHWPRIP |
| 820 Thanatin | Podisus maculiventris | 21 | GSKKPVPIIYCNRRTGKCQRM |
| 821 Theta Defensin 1 | Macaca mulatta | 18 | GFCRCLCRRGVCRCICTR |
| 822 theta defensin 1a precursor | Macaca mulatta | 76 | MRTFALLTAMLLLVALHAQAEARQARADEAAAQQQ PGTDDQGMAHSFTWPENAALPLSESAKGLRCICTR GFCRLL |
| 823 theta defensin 1b precursor | Macaca mulatta | 76 | MRTFALLTAMLLLVALHAQAEARQARADEAAAQQQ PGADDQGMAHSFTRPENAALPLSESARGLRCLCRR GVCQLL |
| 824 theta defensin-1 | Macaca mulatta | 18 | RCICTRGFCRCLCRRGVC |
| 825 Tigerinin-1 | Hoplobatrachus tigerinus | 11 | FCTMIPIPRCY |
| 826 Tigerinin-2 | Hoplobatrachus tigerinus | 12 | RVCFAIPLPICH |
| 827 Tigerinin-3 | Hoplobatrachus tigerinus | 12 | RVCYAIPLPICY |
| 828 Tigerinin-4 | Hoplobatrachus tigerinus | 11 | RVCYAIPLPIC |
| 829 tracheal antimicrobial peptide | Bos taurus | 64 | MRLHHLLLALLFLVLSASSGFTQGVGNPVSCVRNK GICVPIRCPGNMKQIGTCVGRAVKCCRKK |
| 830 Tracheal antimicrobial peptide precursor (TAP) | Bos taurus | 64 | MRLHHLLLALLFLVLSAWSGFTQGVGNPVSCVRNK GICVPIRCPGSMKQIGTCVGRAVKCCRKK |
| 831 Xenopsin precursor [Contains: Xenopsin precursor fragment (XPF); Xenopsin] | Xenopus laevis | 81 | MYKGIFLCVLLAVICANSLATPSSDADEDNDEVERY VRGWASKIGQTLGKIAKVGLKELIQPKREAMLRSAE AQGKRPWIL |

TABLE 1-continued

Plant Antimicrobial Peptides

| Protein Name | Organism Name | Length | Sequence |
|---|---|---|---|
| 832 22K antifungal protein | Zea mays | 206 | AVFTVVNQCPFTVWAASVPVGGGRQLNRGESWRI TAPAGTTAARIWARTGCQFDASGRGSCRTGDCGG VVQCTGYGRAPNTLAEYALKQFNNLDFFDISLIDGF NVPMSFLPDGGSGCSRGPRCAVDVNARCPAELRQ DGVCNNACPVFKKDEYCCVGSAANNCHPTNYSRY FKGQCPDAYSYPKDDATSTFTCPAGTNYKVVFCP |
| 833 AC-AMP1 =ANTIMICROBIAL peptide | Amaranthus caudatus | 29 | VGECVRGRCPSGMCCSQFGYCGKGPKYCG |
| 834 Alpha-amylase/trypsin inhibitor (Antifungal protein) | Zea mays | 206 | AVFTVVNQCPFTVWAASVPVGGGRQLNRGESWRI TAPAGTTAARIWARTGCQFDASGRGSCRTGDCGG VVQCTGYGRAPNTLAEYALKQFNNLDFFDISILDGF NVPYSFLPDGGSGCSRGPRCAVDVNARCPAELRQ DGVCNNACPVFKKDEYCCVGSAANNCHPTNYSRY FKGQCPDAYSYPKDDATSTFTCPAGTNYKVVFCP |
| 835 Alpha-basrubrin (Fragment) | Basella alba | 20 | GADFQECMKEHSQKQHQHQG |
| 836 antifungal 25K protein | Linum usitatissimum | 37 | ARFDIQNKCPYTVWAASVPVGGGRQLNSGQTWXID AP |
| 837 antifungal 27K protein | Diospyros texana | 30 | ATFDIQNKXTYTVWAAAWAPSYPGGXKQLD |
| 838 antifungal 2S storage albumin large chain | Raphanus sativus | 20 | PQGPQQRPPLLQQCCNNLLQ |
| 839 antifungal 2S storage albumin small chain | Raphanus sativus | 30 | PAGPFRIPRCRREFQQAQHLRACQQWLHRQ |
| 840 Antifungal Peptide | Phytolacca americana | 38 | AGCIKNGGRCNASAGPPYCCSSYCFQIAGQSYGVC KNR |
| 841 Antifungal peptide 1 (EAFP1) | Eucommia ulmoides | 41 | QTCASRCPRPCNAGLCCSIYGYCGSGNAYCGAGN CRCQCRG |
| 842 Antifungal peptide 2 (EAFP2) | Eucommia ulmoides | 41 | QTCASRCPRPCNAGLCCSIYGYCGSGAAYCGAGN CRCQCRG |
| 843 Antifungal protein | Gastrodia elata | 171 | MAASASTAVILFFAVTTMMSLSAIPAFASDRLNSDH QLDTGGSLAQGGYLFIIQNDCNLVLYDNNRAVWAS GTNGKASNCFLKMQNDGNLVIYSGSRAIWASNTNR QKGNYYLILQRDRNVVIYDNSNNAIWATHTNVGNAE ITVIPHSNGTAAASGAAQNKVNELYISMY |
| 844 Antifungal protein | Gastrodia elata | 169 | MASPASSAVIFLFAVAALMSLLAMPALAASQLNAGQ TLGTGQSLAQGPDQFVIQNDCNLVLYDSNRVVWAS GTNGKASGCVLRMQRDGNLVIYSGSRVIWASNTNR RDDNYYLLLQRDRNVVIYDSSNNAIWATGTNVGNA AITVIPHSNGTAAASGAAQNKVNEYLRP |
| 845 Antifungal protein | Ipomoea nil | 92 | MKFCTMFLVVLALASLLLTPSTIMAQQCGSQARGRL CGNGLCCSQWGYCGSTAAYCGAGCQSQCKSTAA SATDTTTTANQSTAKSDPAGGAN |
| 846 Antifungal protein | Capsicum annuum | 85 | MKFQVVILVLFALLLTRTSAQNCGRQAGRRVCANRL CCSQFGFCGTTREYCGAGCQSNCRRYATDTTGEG ENVNNDEHKNNGGPN |
| 847 Antifungal protein | Ipomoea nil | 91 | MKYCTMFIVLLGLGSLLLTPTTIMAQQCGRQASGRL CGNGLCCSQWGYCGSTAAYCGAGCQSQCKSTAA SSTTTTTANQSTAKSDPAGGAN |
| 848 antifungal protein 1 | Sinapis alba | 25 | QKLCERPSGTWSGVCGNNNACKNQC |

TABLE 1-continued

| | | | |
|---|---|---|---|
| 849 antifungal protein 1 | Brassica napus | 30 | QKLCERPSGTWSGVCGNNNACKNQCINLEK |
| 850 antifungal protein 1 | Arabidopsis thaliana | 27 | QKLCERPSGTWSGVCGNSNACKNQCIN |
| 851 Antifungal Protein 1 | Raphanus sativus | 51 | XKLCERPSGTWSGVCGNNNACKNQCINLEKARHG SCNYVFPAHKCICYFPC |
| 852 Antifungal protein 1 large subunit (CW-1) (Fragment) | Malva parviflora | 15 | VAGPFRIPPLRREFQ |
| 853 Anti-fungal protein 1 precursor (PAFP-S) | Phytolacca americana | 65 | MAKVSSAYLKFALVMILLLSVISAVMSAGCIKNGGRC NASAGPPYCCSSYCFQIAGQSYGVCKNR |
| 854 Antifungal protein 1 small subunit (CW-1) (Fragment) | Malva parviflora | 16 | PAGPFRIPPRRXEFQ |
| 855 antifungal protein 2 | Sinapis alba | 26 | QKLCQRPSGTWSGVCGNNNACRNQCI |
| 856 Antifungal protein 2 large subunit (CW-2) (Fragment) | Malva parviflora | 20 | PEDPQRRYQEXQREXRXQQE |
| 857 Antifungal protein 3 (CW-3) (Fragment) | Malva parviflora | 15 | PEDPQRRYQEEQRRE |
| 858 Antifungal protein 4 (CW-4) (Fragment) | Malva parviflora | 37 | DRQIDMEEQQLEKLNKQDRXPGLRYAAKQQMXTX RMG |
| 859 Antifungal protein 5 (CW-5) (Fragment) | Malva parviflora | 38 | ITCGQVTSQVAGCLSYLQRGGAPAPXXXXGIRNLXX MA |
| 860 Antifungal protein AX1 | Beta vulgaris | 46 | AICKKPSKFFKGACGRDADCEKACDQENWPGGVC VPFLRCECQRSC |
| 861 Antifungal protein AX2 | Beta vulgaris | 46 | ATCRKPSMYFSGACFSDTNCQKACNREDWPNGKC LVGFKCECQRPC |
| 862 Antifungal protein GAFP-1 (Fragment) | Gastrodia elata | 129 | SDRLNSGHQLDTGGSLAEGGYLFIIQNDCNLVLYDN NRAVWASGTNGKASGCVLKMQNDGNLVIYSGSRAI WASNTNRQNGNYYLILQRDRNVVIYDNSNNAIWAT HTNVGNAEITVIPHSNGTAAASG |
| 863 Antifungal protein precursor | Medicago sativa | 72 | MEKKSLAGLCFLFLVLFVAQEIVVTEARTCENLADKY RGPCFSGCDTHCTTKENAVSGRCRDDFRCWCTKRC |
| 864 Antifungal protein precursor | Gastrodia elata | 178 | MLEWGDGVFCGGCVGYLRGDSVECGNCSDRLNS GHQLDTGGSLAQGGYLFIIQNDCNLVLYDNNRAVW ASGTNGKASGCVLKMQNDGNLVIYSGSRAIWASNT NRQNGNYYLILQRDRNVVIYDNSNNAIWATHTNVG NAEITAIPHSNGTAAASGAAQNKVNELYISMYSRSK RIAG |
| 865 Antifungal protein R (Fragment) | Hordeum vulgare | 44 | ATITVVNRCSYTVWPGALPGGGVRLDPGQRWALN MPAGTAGAAV |
| 866 Antifungal protein S (Fragment) | Hordeum vulgare | 37 | ATFTVINKCQYTVWAAAVPAGGGQKLDAGQTWSIX XP |
| 867 Antifungal protein-like | Arabidopsis thaliana | 80 | MAKSATIITFLFAALVLFAAFEAPTMVEAQKLCEKPS GTWSGVCGNSNACKNQCINLEGAKHGSCNYVFPA HKCICYVPC |

TABLE 1-continued

| | | | |
|---|---|---|---|
| 868 | Antimicrobial defensin peptide DRR230-c (Fragment) | *Pisum sativum* | 60 | ALSFLFLFLFVAQEIVVTEANTCEHLADTYRGVCFTD ASCDDHCKNKAHLISGTCHNFKC |
| 869 | Antimicrobial Peptide 1 | *Macadamia integrifolia* | 76 | SAFTVWSGPGCNNRAERYSKCGCSAIHQKGGYDF SYTGQTAALYNQAGCSGVAHTRFGSSARACNPFG WKSIFIQC |
| 870 | Antimicrobial peptide 1 precursor | *Mesembryanthemum crystallinum* | 64 | MAKVSSSLLKFAIVLILVLSMSAIISAKCIKNGKGCRE DQGPPFCCSGFCYRQVGWARGYCKNR |
| 871 | Antimicrobial peptide 1 precursor (AMP1) | *Macadamia integrifolia* | 102 | MASTKLFFSVITVMMLIAMASEMVNGSAFTVWSGP GCNNRAERYSKCGCSAIHQKGGYDFSYTGQTAALY NQAGCSGVAHTRFGSSARACNPFGWKSIFIQC |
| 872 | Antimicrobial peptide 1 precursor (AMP1) (MJ-AMP1) (Fragment) | *Mirabilis jalapa* | 61 | LPVAFLKFAIVLILFIAMSAMIEAQCIGNGGRCNENVG PPYCCSGFCLRQPGQGYGYCKNR |
| 873 | Antimicrobial Peptide 2 | *Amaranthus caudatus* | 30 | VGECVRGRCPSGMCCSQFGYCGKGPKYCGR |
| 874 | Antimicrobial peptide 2 precursor (AMP2) (MJ-AMP2) | *Mirabilis jalapa* | 63 | MAKVPIAFLKFVIVLILFIAMSGMIEACIGNGGRCNEN VGPPYCCSGFCLRQPNQGYGVCRNR |
| 875 | Antimicrobial peptide D1 (so-D1) (Defensin D1) (Fragment) | *Spinacia oleracea* | 22 | XTCESPSHKFKGPCATNRNCES |
| 876 | Antimicrobial peptide D2 (So-D2) (Defensin D2) (Fragment) | *Spinacia oleracea* | 52 | GIFSSRKCKTPSKTFKGICTRDSNCDTSCRYEGYPA GDCKGIRRRCMCSKPC |
| 877 | Antimicrobial peptide D3 (So-D3) (Defensin D3) (Fragment) | *Spinacia oleracea* | 25 | GIFSSRKCKTVSKTFRGICTRNANC |
| 878 | Antimicrobial peptide D4 (So-D4) (Defensin D4) (Fragment) | *Spinacia oleracea* | 23 | MFFSSKKCKTVSKTFRGPCVRNA |
| 879 | Antimicrobial peptide D5 (So-D5) (Defensin D5) (Fragment) | *Spinacia oleracea* | 24 | MFFSSKKCKTVXKTFRGPCVRNAN |
| 880 | Antimicrobial peptide D6 (So-D6) (Defensin D6) (Fragment) | *Spinacia oleracea* | 24 | GIFSNMYXRTPAGYFRGPXGYXXN |
| 881 | Antimicrobial peptide D7 (So-D7) (Defensin D7) (Fragment) | *Spinacia oleracea* | 38 | GIFSSRKCKTPSKTFKGYCTRDSNCDTSCRYEGYP AGD |
| 882 | Antimicrobial peptide MBP-1 | *Zea mays* | 33 | RSGRGECRRQCLRRHEGQPWETQECMRRCRRRG |
| 883 | Antimicrobial peptide shep-GRP | *Capsella bursa-pastoris* | 120 | MASKTLILLGLFAILLVVSEVSAARESGMVKPESEET VQPEGYGGHGHGGHGGHGGHGGHGGHGGGGHG LDGYHGGHGGHGGGYNGGGGHGGHGGGYNGGG HHGGGGHGLNEPVQTQPGV |

TABLE 1-continued

| | | | |
|---|---|---|---|
| 884 | Antimicrobial peptides precursor (IB-AMP) [Contains: Basic peptide AMP3 (IB-AMP3); Basic peptide AMP1-1 (IB-AMP1-1); Basic peptide AMP1-2 (IB-AMP1-2); Basic peptide AMP1-3 (IB-AMP1-3); Basic peptide A | *Impatiens balsamina* | 333 | MVQKGVVFGVLLILFICSTLTSADSKPNPTKEEEPAK KPDEVSVKSGGPEVSEDQYRHRCCAWGPGRKYCK RWCANAEEAAAAIPEASEELAQEEAPVYSEDQWGR RCCGWGPGRRYCVRWCQNAEEAAAAIPEATEKAQ EAPVYSEDQWGRRCCGWGPGRRYCVRWCQNAE EAAAAVAIPEASEKAQEGPVYSEDQWGRRCCGWG PGRRYCVRWCSNAADEVATPEDVEPGQYGRRCC NWGPGRRYCKRWCHNAAEEATLKAFEEEAAREQP VYSEDQWGRRCCGWGPGRRYCRRWCQSAEEAA AFQAGEVTASLMLIMFKACPCMGPVPSV |
| 885 | Antimicrobial protein Ace-AMP1 precursor | *Allium cepa* | 132 | MVRVVSLLAASTFILLIMIISSPYANSQNICPRVNRIVT PCVAYGLGRAPIAPCCRALNDLRFVNTRNLRRAAC RCLVGVVNRNPGLRRNPRFQNIPRDCRNTFVRPFW WRPRIQCGRINLTDKLIYLDAEE |
| 886 | Antimicrobial protein PN-AMP (PN-AMP1/PN-AMP2) | *Ipomoea nil* | 41 | QQCGRQASGRLCGNRLCCSQWGYCGSTASYCGA GCQSQCRS |
| 887 | antimicrobial protein precursor | *Amaranthus hypochondriacus* | 86 | MVNMKCVALIVIVMMAFMMVDPSMGVGECVRGRC PSGMCCSQFGYCGKGPKYCGRASTTVDHQADVAA TKTAKNPTDAKLAGAGSP |
| 888 | Antimicrobial seed protein (Fragment) | *Phytolacca americana* | 37 | ACIKNGGRCVASGGPPYCCSNYCLQIAGQSYGVCK KH |
| 889 | avematin | *Avena sativa* | 26 | TTITVVNKCSYTVWPGALPGGGVVLD |
| 890 | Basal layer antifungal peptide precursor | *Zea mays* | 93 | MAKFFNYTIIQGLLMLSMVLLASCAIHAHIISGETEEV SNTGSPTVMVTMGANRKIIEDNKNLLCYLRALEYCC ARTRQCYDDIKKCLEHCRG |
| 891 | Basal layer antifungal peptide precursor | *Zea mays* | 96 | MVKILDHISIRGFFLLFMVLVASFVGHAQIIRGETKED NDTKSMTMTTMRPGSYVTSMDEKSSLCFEDIKTLW YICRTTYHLYRTLKDCLSHCNSM |
| 892 | Basal layer antifungal peptide precursor | *Zea mays* | 95 | MVKSLDHITIRGLFLLFMFLVASFVGHAQIIRGETKEN KDTNSMTMTTRPGSYVISMDEKSSLCFLDPRTLWYI CKITYRLFRTLKDCLEFCHSI |
| 893 | Basal layer antifungal peptide precursor | *Zea mays* | 73 | MVLLASCVIHAHIISGEIEDVSNTRSPTMMGANRKIIG DNKNLLCYLKALEYCCERTKQCYDDIKKCLEHCHS |
| 894 | Beta-basrubin (Fragment) | *Basella alba* | 16 | KIMAKPSKFYEQLRGR |
| 895 | CBP20 (Fragment) | *Nicotiana tabacum* | 208 | GKLSTLLLVLILYFIAAGANAQQCGRQRGGALCSGN LCCSQFGWCGSTPEYCSPSQGCQSQCSGGGGGG GGGGGGGAQNVRATYHIYNPQNVGWDLYAVSAYC STWDGNKPLAWRRKYGWTAFCGPVGPRGRDSCG KCLRVTNTGTGAQTTVRIVDQCSNGGLDLDVNVFR QLDTDGRGNQRGHLIVNYEFVNCGDNMNVLLSPVD KE |
| 896 | CBP20 preproprotein | *Nicotiana tabacum* | 211 | MGKLSTLLFALVLYVIAAGANAQQCGRQRGGALCS GNLCCIQFGWCGSTQEYCSPSQGCQSQCSGGGGG GGGGGGGGAAQNVRATYHIYNPQNVGWDLYA VSAYCSTWDGNKPLAWRRKYGWTAFCGPVGPRG RDSCGKCLRVTNTGTGAQTTVRIVDQCSNGGLDLD VNVFRQLDTDGRGNQRGHLIVNYEFVNCGDNMNV LVSPVDKE |

TABLE 1-continued

| | | | |
|---|---|---|---|
| 897 chitinase (EC 3.2.1.14)/ lysozyme (EC 3.2.1.17) PZ precursor, pathogenesis-related | Nicotiana tabacum | 378 | MANSVTLFSIIFSCFLLRQLVCTNSQNVIKGGYWFKN SGLALNNIDSTLFTHLFCAFADLNPQSNQLIISPENQ DSFSQFTSTVQRKNPSVKTFLSIAGGRADTTAYGIM ARQPNSRKSFIDSSIRLARQFGFHGLDLDWEYPLSA TDMTNLGILLNEWRTAINMEARNSGRAALLLTAAVS YSPRVNGLNYPVESVARNLNWINLMAYDFYGPNWS PSQTNSHAQLFDPVNHISGSDGINAWIQAGVPTKKL VLGIPFYGYAWRLVNPNIHDLRAPAAGKSNVGAVD DGSMTYNRIRDYIVQSRATTVYNATIVGDYCYSGSN WISYDDTQSVRNKVNYVKGRGLLGYFAWHVAGDQ NWGLSRTASQTWGVSSQEMK |
| 898 chitinase (EC 3.2.1.14) A | Zea mays | 280 | MANAPRILALGLLALLCAAAGPAAAQNCGCQPNFC CSKFGYCGTTDAYCGDGCQSGPCRSGGGGGGGG GGGGGGSGGANVANVVTDAFFNGIKNQAGSGCEG KNFYTRSAFLSAVNAYPGFAHGGTEVEGKREIAAFF AHVTHETGHFCYISEINKSNAYCDASNRQWPCAAG QKYYGRGPLQISWNYNYGPAGRDIGFNGLADPNRV AQDAVIAFKTALWFWMNNVHRVMPQGFGATIRAIN GALECNGNNPAQMNARVGYYKQYCQQLRVDPGP NLIC |
| 899 chitinase (EC 3.2.1.14) precursor | Zea mays | 268 | QLVALGLALLCAVAGPAAAQNCGCQPNVCCSKFGY CGTTDEYCGDGCQSGPCRSGRGGGGSGGGGANV ASVVTSSFFNGIKNQAGSGCEGKNFYTRSAFLSAVK GYPGFAHGGSQVQGKREIAAFFAHATHETGHFCYI SEINKSNAYCDPTKRQWPCAAGQKYYGRGPLQISW NYNYGPAGRAIGFDGLGDPGRVARDAVVAFKAALW FWMNSVHGVVPQGFGATTRAMQRALECGGNNPA QMNARVGYYRQYCRQLGVDPGPNLTC |
| 900 Chitinase, class V | Nicotiana tabacum | 377 | MANSVTLFAIIFSCFLLQQLVCTNSQNVKGGYWFKD SGLALNNIDSTLFTHLFCAFADLNPQNQLIISPENQ DSFRQFTSTVQRKNPSVKTFLSIAGGRANSTAYGIM ARQPNSRKSFIDSSIRLARQLGFHGLDLDWEYPLSA ADMTNLGTLLNEWRTAINTEARNSGRAALLLTAAVS NSPRVNGLNYPVESLARNLDWINLMAYDFYGPNWS PSQTNSHAQLFDPVNHVSGSDGINAWIQAGVPTKK LVLGIPFYGYAWRLVNANIHGLRAPAAGKSNVGAVD DGSMTYNRIRDYIVESRATTVYNATIVGDYCYSGSN WISYDDTQTVRNKVNYVKGRGLLGYFAWHVAGDQ NWGLSRTASQTWGVSFQEMK |
| 901 Chitin-binding protein HM30 (Fragment) | Hydrangea macrophylla | 15 | NSMERVEELRKKLQD |
| 902 Chitin-binding protein N, CBP N (Fragments) | Hordeum vulgare | 52 | ATYHYYRPAQNNWDLGAPAVSAYCATWDASKYGW TAFIVDQCANGGLDLDWN |
| 903 Circulin A (CIRA) | Chassalia parviflora | 30 | GIPCGESCVWIPCISAALGCSCKNKVCYRN |
| 904 Circulin B (CIRB) | Chassalia parviflora | 31 | GVIPCGESCVFIPCISTLLGCSCKNKVCYRN |
| 905 Cyclopsychotride A (CPT) | Psychotria longipes | 31 | SIPCGESCVFIPCTVTALLGCSCKSKVCYKN |
| 906 Cysteine-rich antifungal protein 1 (AFP1) (Fragment) | Brassica rapa | 27 | QKLCERPSGTWSGVCGNNNACKNQCIN |
| 907 Cysteine-rich antifungal protein 1 (AFP1) (M1) | Sinapis alba | 51 | QKLCERPSGWSGVCGNNNACKNQCINLEKARHG SCNYVFPAHKCICYFPC |
| 908 Cysteine-rich antifungal protein 1 precursor (AFP1) | Raphanus sativus | 80 | MAKFASIIALLFAALVLFAAFEAPTMVEAQKLCERPS GTWSGVCGNNNACKNQCINLEKARHGSCNYVFPA HKCICYFPC |

TABLE 1-continued

| | | | |
|---|---|---|---|
| 909 Cysteine-rich antifungal protein 1 precursor (AFP1) (Anther-specific protein S18 homolog) | Arabidopsis thaliana | 80 | MAKSATIVTLFFAALVFFAALEAPMVVEAQKLCERP SGTWSGVCGNSNACKNQCINLEKARHGSCNYVFP AHKCICYFPC |
| 910 Cysteine-rich antifungal protein 2 (AFP2) (Fragment) | Brassica napus | 23 | QKLCERPSGTWSGVCGNNNACKN |
| 911 Cysteine-rich antifungal protein 2 (AFP2) (Fragment) | Brassica rapa | 27 | QKLCERPSGTXSGVCGNNNACKNQCIR |
| 912 Cysteine-rich antifungal protein 2 precursor (AFP2) | Raphanus sativus | 80 | MAKFASIIVLLFVALVVFAAFEEPTMVEAQKLCQRPS GTWSGVCGNNNACKNQCIRLEKARHGSCNYVFPA HKCICYFPC |
| 913 Cysteine-rich antifungal protein 2A (AFP2A) (M2A) | Sinapis alba | 51 | QKLCQRPSGTWSGVCGNNNACRNQCINLEKARHG SCNYVFPAHKCICYFPC |
| 914 Cysteine-rich antifungal protein 2B (AFP2B) (M2B) | Sinapis alba | 52 | QKLCARPSGTWSSGNCRNNNACRNFCIKLEKSRH GSCNIPFPSNKCICYFPC |
| 915 Cysteine-rich antifungal protein 3 precursor (AFP3) | Brassica napus | 79 | MAKFASIITLLFAALVVFAAFEAPTMVEAKLCERSSG TWSGVCGNNNACKNQCIRLEGAQHGSCNYVFPAH KCICYFPC |
| 916 Cysteine-rich antifungal protein 3 precursor (AFP3) | Raphanus sativus | 79 | MAKFASIVALLFAALVVFAAFEAPTVVEAKLCERSSG TWSGVCGNNNACKNQCIRLEGAQHGSCNYVFPAH KCICYFPC |
| 917 Cysteine-rich antifungal protein 4 precursor (AFP4) | Raphanus sativus | 80 | MAKFVSIITLLFVALVLFAAFEAPTMVEAQKLCERSS GTWSGVCGNNNACKNQCINLEGARHGSCNYIFPYH RCICYFPC |
| 918 Defense-related peptide 1 (Defensin 1) (Antifungal protein Psd1) | Pisum sativum | 46 | KTCEHLADTYRGVCFTNASCDDHCKNKAHLISGTC HNWKCFCTQNC |
| 919 Defense-related peptide 2 (Defensin 2) (Antifungal protein Psd2) | Pisum sativum | 47 | KTCENLSGTFKGPCIPDGNCNKHCRNNEHLLSGRC RDDFRCWCTNRC |
| 920 defensin | Capsicum annuum | 75 | MAGFSKVIATIFLMMMLVFATDMMAEAKICEALSGN FKGLCLSSRDCGNVCRREGFTSGVCRGFPLKCFCR KPGA |
| 921 Defensin | Brassica rapa | 80 | MAKFVSIITLFFAALVLFAAFEAPTMVKAQKLCERSS GTWSGVCGNNNACKNQCINLEGARHGSCNYVFPY HRCICYFPC |
| 922 Defensin | Helianthus annuus | 108 | MAKISVAFNAFLLLLFVLAISEIGSVKGELCEKASQT WSGTCGKTKHCDDQCKSWEGAAHGACHVRDGKH MCFCYFNCSKAQKLAQDKLRAEELAKEKIEPEKATA KP |

TABLE 1-continued

| | | | |
|---|---|---|---|
| 923 Defensin (Fragment) | Helianthus annuus | 41 | SHRFQGTCLSDTNCANVCHSERFSGGKCRGFRRR CFCTTHC |
| 924 defensin 1 precursor | Triticum aestivum | 82 | MASTRRMAAAPAVLLLLLLLVATEMGTMKTAEARTC LSQSHKFKGTCLSNSNCAAVCRTENFPDGECNTHL VERKCYCKRTC |
| 925 defensin AFP1 | Heuchera sanguinea | 54 | DGVKLCDVPSGTWSGHCGSSSKCSQQCKDREHFA YGGACHYQFPSVKCFCKRQC |
| 926 defensin AMP1 | Dahlia merckii | 50 | ELCEKASKTWSGNCGNTGHCDNQCKSWEGAAHG ACHVRNGKHMCFCYFNC |
| 927 defensin AMP1 | Aesculus hippocastanum | 50 | LCNERPSQTWSGNCGNTAHCDKQCQDWEKASHG ACHKRENHWKCFCYFNC |
| 928 defensin AMP1 | Clitoria ternatea | 49 | NLCERASLTWTGNCGNTGHCDTQCRNWESAKHG ACHKRGNWKCFCYFNC |
| 929 defensin AMP2 | Dahlia merckii | 20 | EVCEKASKTWSGNCGNTGHC |
| 930 Defensin CUA1 (Fragment) | Helianthus annuus | 42 | LSHSFKGTCLSDTNCANVCHSERFSGGKCRGFRR RCFCTTHC |
| 931 Defensin EGAD1 | Elaeis guineensis | 77 | MEHSRRMLPAILLLLFLLMPSEMGTKVAEARTCESQ SHKFQGTCLRESNCANVCQTEGFQGGVCRGVRRR CFCTRLC |
| 932 Defensin J1-1 precursor | Capsicum annuum | 75 | MAGFSKVVATIFLMMLLVFATDMMAEAKICEALSGN FKGLCLSSRDCGNVCRREGFTDGSCIGFRLQCFCT KPCA |
| 933 Defensin J1-2 precursor | Capsicum annuum | 74 | MAGFSKVIATIFLMMMLVFATGMVAEARTCESQSH RFKGLCFSKSNCGSVCHTEGFNGGHCRGFRRRCF CTRHC |
| 934 Defensin precursor | Brassica oleracea | 80 | MAKVASIVALLFPALVIFAAFEAPTMVEAQKLCERPS GTWSGVCGNNNACKNQCIRLEKARHGSCNYVFPA HKCICYFPC |
| 935 Defensin protein 1 | Prunus persica | 79 | MERSMRLFSTAFVFFLLLAAAGMMMGPMVAEARTC ESQSNRFKGTCVSTSNCASVCQTEGFPGGHCRGF RRRCFCTKHC |
| 936 Endochitinase A precursor (EC 3.2.1.14) (Seed chitinase A) | Zea mays | 280 | MANAPRILALGLLALLCAAAGPAAAQNCGCQPNFC CSKFGYCGTTDAYCGDGCQSGPCRSGGGGGGGG GGGGGGSGGANVANVVTDAFFNGIKNQAGSGCEG KNFYTRSAFLSAVNAYPGFAHGGTEVEGKREIAAFF AHVTHETGHFCYISEINKSNAYCDASNRQWPCAAG QKYYGRGPLQISWNYNYGPAGRDIGFNGLADPNRV AQDAVIAFKTALWFWMNNVHGVMPQGFGATIRAIN GALECNGNNPAQMNARVGYYKQYCQQLRVDPGP NLIC |
| 937 Endochitinase B precursor (EC 3.2.1.14) (Seed chitinase B) (Fragment) | Zea mays | 269 | PQLVALGLALLCAVAGPAAAQNCGCQPNVCCSKFG YCGTTDEYCGDGCQSGPCRSGRGGGSGGGGAN VASVVTSSFFNGIKNQAGSGCEGKNFYTRSAFLSAV KGYPGFAHGGSVQQGKREIAAFFAHATHETGHFCY ISEINKSNAYCDPTKRQWPCAAGQKYYGRGPLQIS WNYNYGPAGRAIGFDGLGDPGRVARDAVVAPKAAL WFWMNSVHGVVPQGFGATTRAMQRALECGGNNP AQMNARVGYYRQYCRQLGVDPGPNLTC |
| 938 Fabatin-1 | Vicia faba | 47 | LLGRCKVKSNRFHGPCLTDTHCSTVCRGEGYKGG DCHGLRRRCMCLC |
| 939 Fabatin-2 | Vicia faba | 47 | LLGRCKVKSNRFNGPCLTDTHCSTVCRGEGYKGG DCHGLRRRCMCLC |
| 940 Floral defensin-like protein 1 | Petunia × hybrida | 103 | MARSICFFAVAILALMLFAAYDAEAATCKAECPTWD SVCINKKPCVACCKKAKFSDGHCSKILRRCLCTKEC VFEKTEATQTETFTKDVNTLAEALLEADMMV |
| 941 Floral defensin-like protein 2 | Petunia × hybrida | 101 | MARSICFFAVAILALMLFAAYETEAGTCKAECPTWE GICINKAPCVKCCKAQPEKFTDGHCSKILPRCLCTK PCATEEATATLANEVKTMAEALVEEDMME |

| | | | |
|---|---|---|---|
| 942 Flower-specific gamma-thionin precursor (Defensin SD2) | Helianthus annuus | 78 | MKSSMKMFAALLLVVMCLLANEMGGPLVVEARTCE SQSHKFKGTCLSDTNCANVCHSERFSGGKCRGFR RRCFCTTHC |
| 943 Gamma-thionin homolog At2g02100 precursor | Arabidopsis thaliana | 77 | MKLSMRLISAVLIMFMIFVATGMGPVTVEARTCESQ SHRFKGTCVSASNCANVCHNEGFVGGNCRGFRRR CFCTRHC |
| 944 Gamma-thionin homolog At2g02120 precursor | Arabidopsis thaliana | 77 | MKFSMRLISAVLFLVMIFVATGMGPVTVEARTCASQ SQRFKGKCVSDTNCENVCHNEGFPGGDCRGFRRR CFCTRNC |
| 945 Gamma-thionin homolog At2g02130 precursor | Arabidopsis thaliana | 77 | MKLSVRFISAALLLFMVFIATGMGPVTVEARTCESKS HRFKGPCVSTHNCANVCHNEGFGGGKCRGFRRRC YCTRHC |
| 946 Gamma-thionin homolog At2g02140 precursor | Arabidopsis thaliana | 73 | MKLSLRLISALLMSVMLLFATGMGPVEARTCESPSN KFQGVCLNSQSCAKACPSEGFSGGRCSSLRCYCS KAC |
| 947 Gamma-thionin1 precursor | Eutrema wasabi | 80 | MAKFASIIALLFAALVLFSAFEAPSMVEAQKLCEKSS GTWSGVCGNNNACKNQCINLEGARHGSCNYIFPYH RCICYFPC |
| 948 gamma-thionin-like protein precursor | Lycopersicon esculentum | 105 | MARSIFFMAFLVLAMMLFVTYEVEAQQICKAPSQTF PGLCFMDSSCRKYCIKEKFTGGHCSKLQRKCLCTK PCVFDKISSEVKATLGEEEAKTLSEVVLEEEIMME |
| 949 Gastrodianin-MGM protein | Gastrodia elata | 171 | MAASASTAVILFFAVTTMMSLSAIPAFASDRLNSGH QLDTGGSLAQGGYLFIIQNDCNLVLYDNNRAVWAS GTNGKASGCMLKMQNDGNLVIYSGSRAIWASNTNR QNGNYYLILQRDRNVVIYDNSNNAIWATHTNVGNAE ITVIPHSNGTAAASGAAQNKVNELYISMY |
| 950 Gastrodianin-MNF protein | Gastrodia elata | 171 | MAASASTAVILFFAVTTMMSLSAIPAFASDRLNSGH QLDTGGSLAQGGYLFIIQNDCNLVLYDNNRAVWAS GTNGKASNCFLKMQNDGNLVIYSGSRAIWASNTNR QNGNYYLILQRDRNVVIYDNSNNAIWATHTNVGNAE ITVIPHSNGTAAASGAAQNKVNELYISMY |
| 951 Gastrodianin-VGM protein | Gastrodia elata | 171 | MAASASTAVILFFAVTTVMSLSAIPAFASDRLNSGHQ LDTGGSLAQGGYLFIIQNDCNLVLYDNNRAVWASG TNGKASGCMLKMQNDGNLVIYSGSRAIWASNTNRQ NGNYYLILQRDRNVVIYDNSNNAIWATHTNVGNAEI TVIPHSNGTAAASGAAQNKVNELYISMY |
| 952 Gastrodianin-VNF protein | Gastrodia elata | 171 | MAASASTAVILFFAVTTVMSLSAIPAFASDRLNSGHQ LDTGGSLAQGGYLFIIQNDCNLVLYDNNRAVWASG TNGKASNCFLKMQNDGNLVIYSGSRAIWASNTNRQ NGNYYLILQRDRNVVIYDNSNNAIWATHTNVGNAEI TVIPHSNGTAAASGAAQNKVNELYISMY |
| 953 Genomic DNA, chromosome 5, P1 clone:MBK5 | Arabidopsis thaliana | 73 | MENKFFAAFFLLLVLFSSQEIIGGEGRTCQSKSHHF KYMCTSNHNCAIVCRNEGFSGGRCHGFHRRCYCT RLC |
| 954 Ginkbilobin (GNL) (Fragment) | Ginkgo biloba | 40 | ANTAFVSSAHNTQKIPAGAPFNRNLRAMLADLRQN AAFAG |
| 955 Hevein precursor (Major hevein) [Contains: Hevein (Allergen Hev b 6); Win-like protein] | Hevea brasiliensis | 204 | MNIFIVVLLCLTGVAIAEQCGRQAGGKLCPNNLCCS QWGWCGSTDEYCSPDHNCQSNCKDSGEGVGGG SASNVLATYHLYNSQDHGWDLNAASAYCSTWDAN KPYSWRSKYGWTAFCGPVGAHGQSSCGKCLSVTN TGTGAKTTVRIVDQCSNGGLDLDVNVFRQLDTDGK GYERGHITVNYQFVDCGDSFNPLFSVMKSSVIN |
| 956 hevein-like antimicrobial peptide | Euonymus europaeus | 320 | MKYLWVFIVFSIAVLSHACSAQQCGRQAGNRRCAN NLCCSQYGYCGRTNEYCCTSQGCQSQCRRCGVR TVGEIVVGDIGGIISKGMFNNILKHRDDDACEGKGFY TYEAFVAAARSFPAFGSTGDDATRKREIAAFLAQTS HETSAGWPSAPDGPYAWGYCFVRERNPPSKYCDT |

TABLE 1-continued

| | | | |
|---|---|---|---|
| | | | TTPCPKSYYGRGPIQLTWNYNYEQAGRAIGADLLN NPDLVATDAVISFKTAIWFWMTAQSSKPSCHDVITG SWRPSASDNSVCHVPDYAVVTNIISGEIEYGKSRNP QVEDRIEFFKRYCQILGVSPGKCYEERTFVSGLMME TI |
| 957 hevein-like antimicrobial peptide | Euonymus europaeus | 305 | MKYLWVFIVFSIAVLSLACSAQQCGRQAGNRRCPN NLCCSQFGYCGRTNEYCCTGFGFCQSNCRRCGVRT VGEDVVGDIGGIISKGMFNNILKHRDDDACEGKGFY TYEAFVAAARSFPAFGSTGDDTTRKREIAAFLAQTS HETSGGRPSAPDGPYAWGYCFVKERNPPSKYCDTI TPCPKSYYGRGPLQLTWNYNYAQAGRAIGVDLLNN PDLVATDAVTSFKTAIWFWMTAHSSKPSCHDVITGS WRPSASDNSVRHVPDYAVVTNIINGEIEYGKSRNPQ VEDRIEFFKRYCQILGVSPGKF |
| 958 Leaf-specific thionin precursor (Clone DB4) | Hordeum vulgare | 137 | MAPSKSIKSVVICVLILGLVLEQVQVEGKSCCKDTLA RNCYNTCHFAGGSRPVCAGACRCKIISGPKCPSDY PKLNLLPESGEPDVTQYCTIGCRNSVCDNMDNVFR GQEMKFDMGLCSNACARFCNDGAVIQSVEA |
| 959 Lectin-like protein (Fragment) | Gastrodia elata | 111 | QSSPGILLNQPASMASPASSAVIFFFAVAALMSLLA MPALAASQLNAGQTLGTGQSLAQGPNQFIIQNDCN LVLYASNKAVWATGTNGKASGCVLRMQRDGNLVIY SGSKV |
| 960 Nicotiana Alata Plant Defensin 1 (Nad1) | Nicotiana tabacum | 47 | RECKTESNTFPGICITKPPCRKACISEKFTDGHCSKI LRRCLCTKPC |
| 961 osmotin precursor | Nicotiana tabacum | 250 | MSNNMGNLRSSFVFFLLALVTYTYAATIEVRNNCPY TVWAASTPIGGGRRLDRGQTWVINAPRGTKMARV WGRTNCNFNAAGRGTCQTGDCGGVLQCTGWGKP PNTLAEYALDQFSGLDFWDISLVDGFNIPMTFAPTN PSGGKCHAIHCTANINGECPRELRVPGGCNNPCTT FGGQQYCCTQGPCGPTFFSKFFKQRCPDAYSYPQ DDPTSTFTCPGGSTNYRVIFCPNGQAHPNFPLEMP GSDEVAK |
| 962 Osmotin-like protein precursor (Pathogenesis-related protein PR-5D) | Nicotiana tabacum | 251 | MSHLTTFLVFFLLAFVTYTYASGVFEVHNNCPYTVW AAATPVGGGRRLERGQSWWFWAPPGTKMARIWG RTNCNFDGAGRGWCQTGDCGGVLECKGWGKPPN TLAEYALNQFSNLDFWDISVIDGFNIPMSFGPTKPG PGKCHGIQCTANINGECPGSLRVPGGCNNPCTTFG GQQYCCTQGPCGPTELSRWFKQRCPDAYSYPQD DPTSTFTCTSWTTDYKVMFCPYGSAHNETTNFPLE MPTSTHEVAK |
| 963 Osmotin-like protein TPM-1 precursor (PR P23) (Fragment) | Lycopersicon esculentum | 238 | FFFLLAFVTYTYAATFEVRNNCPYTVWAASTPIGGG RRLDRGQTWVINAPRGTKMARIWGRTNCNFDGDG RGSCQTGDCGGVLQCTGWGKPPNTLAEYALDQFS NLDFWDISLVDGFNIPMTFAPTNPSGGKCHAIHCTA NINGECPGSLRVPGGCNNPCTTFGGQQYCCTQGP CGPTDLSRFFKQRCPDAYSYPQDDPTSTFTCPSGS TNYRVVFCPNGVTSPNFPLEMPSSDEEAK |
| 964 pathogenesis-related protein P23 precursor | Lycopersicon esculentum | 233 | AFVTYTYAATFEVRNNCPYTVWAASTPIGGGRRLD RGQTWVINAPRGTKMARIWGRTNCNFDGAGRGSC QTGDCGGVLQCTGWGKPPNTLAEYALDQFSNLDF WDISLVDGFNIPMTFAPTNPSGGKCHAIHCTANING ECPGSLRVPGGCNNPCTTFGGQQYCCTQGPCGPT DLSRFFKQRCPDAYSYPQDDPTSTFTCPSGSTNYR VVFCPNGVTSPNFPLEMPSSDEEAK |
| 965 plant defensin protein, putative (PDF2.4) | Arabidopsis thaliana | 76 | MKVSPRLNSALLLLFMILATVMGLVTVEARTCETSS NLFNGPCLSSSNCANVCHNEGFSDGDCRGFRRRC LCTRPC |
| 966 plant defensin-fusion protein, putative | Arabidopsis thaliana | 122 | MERIPSLASLVSLLIIFATVVNQTRASICNDRLGLCDG CDQRCKAKHGPSCESKCDGPVGMLLCTCTYECGP TKLCNGGLGNCGESCNEQCCDRNCAQRYNGGHG YCNTLDDFSLCLCKYPC |
| 967 Plant defensin-like protein (Fragment) | Pyrus pyrifolia | 81 | LVSTAFVLVLLLATIEMGPMGVEARTESSKAVEGKIC EVPSTLFKGLCFSSNNCKHTCRKEQFTRGHCSVLT RACVCTKKC |

TABLE 1-continued

| 968 | probable antifungal protein [imported] | Arabidopsis thaliana | 80 | MAKFCTTITLILVALVLFADFEAPTIVKAELCKRESET WSGRCVNDYQCRDHCINNDRGNDYCAGGYPWY RSCFCFFSC |
| --- | --- | --- | --- | --- |
| 969 | Probable cysteine-rich antifungal protein At2g26010 precursor (AFP) | Arabidopsis thaliana | 80 | MAKSAAIITFLFAALVLFAAFEAPIMVEAQKLCEKPS GTWSGVCGNSNACKNQCINLEGAKHGSCNYVFPA HKCICYFPC |
| 970 | Probable cysteine-rich antifungal protein At2g26020 precursor (AFP) | Arabidopsis thaliana | 80 | MAKFASIITFIYAALVLFAAFEVPTMVEAQKLCEKPS GTWSGVCGNSNACKNQCINLEGAKHGSCNYVFPA HKCICYVPC |
| 971 | Probable cysteine-rich antifungal protein LCR77 precursor (AFP) | Arabidopsis thaliana | 80 | MAKFASIITLIFAALVLFAAFDAPAMVEAQKLCEKPS GTWSGVCGNSNACKNQCINLEGAKHGSCNYVFPA HKCICYVPC |
| 972 | Protease inhibitor-like protein | Pyrus pyrifolia | 87 | MEPSMRLISAAFVLILLLATTEMGPMGVEAKSKSSK EVEKRTCEAASGKFKGMCFSSNNCANTCAREKFD GGKCKGFRRRCMCTKKC |
| 973 | Protease inhibitor-like protein | Pyrus pyrifolia | 87 | MERSMRLVSAAFVLVLLLAATEMGPMGVEARTESS KAVEGKICEVPSTLFKGLCFSSNNCKHTCRKEQFTR GHCSVLTRACVCTKKC |
| 974 | Proteinase inhibitor precursor | Capsicum annuum | 78 | MAHSMRFFAIVLLLAMLVMATEMGPMRIVEARTCES QSHRFKGVCASETNCASVCQTEGFSGGDCRGFRR RCFCTRPC |
| 975 | Putative defensin AMP1 protein | Arabidopsis thaliana | 78 | MASSYTLMLFLCLSIFLIASTEMMAVEGRICERRSKT WTGFCGNTRGCDSQCKRWERASHGACHAQFPGF ACFCYFNC |
| 976 | Putative plant defensin SPI1B | Picea abies | 83 | MADKGVGSRLSALFLLVLLVISIGMMQLEPAEGRTC KTPSGKFKGVCASRNNCKNVCQTEGFPSGSCDFH VANRKCYCSKPCP |
| 977 | sormatin | Sorghum bicolor | 22 | AVFTVVNRCPYTVWAASVPVGG |
| 978 | TOM P14A protein (Fragment) | Lycopersicon esculentum | 41 | AVHNDARAQVGVGPMSXDANLASRAQNYANSRAX DXNLIXS |
| 979 | TOM P14B pathogenesis-related PR-1 protein (Fragments) | Lycopersicon esculentum | 35 | DXLAVHNDARAQVGAGPMDANLASRAQNXANSRAG |
| 980 | TOM P14C pathogenesis-related PR-1 protein (Fragments) | Lycopersicon esculentum | 97 | DYLNAHNAARRQVGVGPMTXDNRLAAFAQNYANQ RADXRMQHSGGPYGENLAAAFPQLNCQAGKVCGH YTQVVWRNSVRLGCARVRCNNGWYFITCN |
| 981 | trimatin | Triticum aestivum | 23 | ATITVVNRCSYTVWPGALPGGGA |
| 982 | Vicilin | Macadamia integrifolia | 666 | MAINTSNLCSLLFLLSLFLLSTTVSLAESEFDRQEYE ECKRQCMQLETSGQMRRCVSQCDKRFEEDIDWSK YDNQDDPQTDCQQCQRRCRQQESGPRQQQYCQ RRCKEICEEEEEYNRQRDPQQQYEQCQERCQRHE TEPRHMQTCQQRCERRYEKEKRKQQKRYEEQQR EDEEKYEERMKEEDNKRDPQQREYEDCRRRCEQQ EPRQQYQCQRRCREQQRQHGRGGDLINPQRGGS GRYEEGEEKQSDNPYYFDERSLSTRFRTEEGHISV LENFYGRSKLLRALKNYRLVLLEANPNAFVLPTHLD ADAILLVTGGRGALKMIHRDNRESYNLECGDVIRIPA GTTFYLINRDNNERLHIAKFLQTISTPGQYKEFFPAG GQNPEPYLSTFSKEILEAALNTQAERLRGVLGQQRE |

| | | | |
|---|---|---|---|
| | | | GVIISASQEQIRELTRDDDSESRRWHIRRGGESSRGP<br>YNLFNKRPLYSNKYGQAYEVKPEDYRQLQDMDVSV<br>FIANITQGSMMGPFFNTRSTKVVVVASGEADVEMA<br>CPHLSGRHGGRRGGKRHEEEEDVHYEQVKARLSK<br>REAIVVPVGHPVVFVSSGNENLLLFAFGINAQNNHE<br>NFLAGRERNVLQQIEPQAMELAFAAPRKEVEELFNS<br>QDESIFFPGPRQHQQQSSRSTKQQQPLVSILDFVGF |
| 983 Vicilin | *Macadamia integrifolia* | 666 | MAINTSNLCSLLFLLSLFLLSTTVSLAESEFDRQEYE<br>ECKRQCMQLETSGQMRRCVSQCDKRFEEDIDWSK<br>YDNQEDPQTECQQCQRRCRQQESGPRQQQYCQR<br>RCKEICEEEEEYNRQRDPQQQYEQCQKHCQRRET<br>EPRHMQTCQQRCERRYEKEKRKQQKRYEEQQRE<br>DEEKYEERMKEEDNKRDPQQREYEDCRRRCEQQE<br>PRQQHQCQLRCREQQRQHGRGGDMMNPQRGGS<br>GRYEEGEEEQSDNPYYFDERSLSTRFRTEEGHISV<br>LENFYGRSKLLRALKNYRLVLLEANPNAFVLPTHLD<br>ADAILLVIGGRGALKMIHHDNRESYNLECGDVIRIPA<br>GTTFYLINRDNNERLHIAKFLQTISTPGQYKEFFPAG<br>GQNPEPYLSTFSKEILEAALNTQTEKLRGVFGQQRE<br>GVIIRASQEQIRELTRDDSESRHWHIRRGGESSRGP<br>YNLFNKRPLYSNKYGQAYEVKPEDYRQLQDMDLSV<br>FIANVTQGSMMGPFFNTRSTKVVVVASGEADVEMA<br>CPHLSGRHGGRRGGGKRHEEEEDVHYEQVRARLSK<br>REAIVVLAGHPWFVSSGNENLLLFAFGINAQNNHE<br>NFLAGRERNVLQQIEPQAMELAFAAPRKEVEESFN<br>SQDQSIFFPGPRQHQQQSPRSTKQQQPLVSILDFV<br>GF |
| 984 Vicilin<br>(Fragment) | *Macadamia integrifolia* | 625 | QCMQLETSGQMRRCVSQCDKRFEEDIDWSKYDNQ<br>EDPQTECQQCQRRCRQQESDPRQQQYCQRRCKE<br>ICEEEEEYNRQRDPQQQYEQCQKRCQRRETEPRH<br>MQICQQRCERRYEKEKRKQQKRYEEQQREDEEKY<br>EERMKEGDNKRDPQQREYEDCRRHCEQQEPRLQ<br>YQCQRRCQEQQRQHGRGGDLMNPQRGGSGRYE<br>EGEEKQSDNPYYFDERSLSTRFRTEEGHISVLENFY<br>GRSKLLRALKNYRLVLLEANPNAFVLPTHLDADAILL<br>VIGGRGALKMIHRDNRESYNLECGDVIRIPAGTTFYL<br>INRDNNERLHIAKFLQTISTPGQYKEFFPAGGQNPE<br>PYLSTFSKEILEAALNTQTERLRGVLGQQREGVIIRA<br>SQEQIRELTRDDSESRRWHIRRGGESSRGPYNLFN<br>KRPLYSNKYGQAYEVKPEDYRQLQDMDVSVFIANIT<br>QGSMMGPFFNTRSTKVVVVASGEADVEMACPHLS<br>GRHGGRGGGKRHEEEEEVHYEQVRARLSKREAIV<br>VLAGHPVVFVSSGNENLLLFAFGINAQNNHENFLAG<br>RERNVLQQIEPQAMELAFAASRKEVEELFNSQDESI<br>FFPGPRQHQQQSPRSTKQQQPLVSILDFVGF |
| 985 Wheatwin1 precursor (Pathogenesis-related protein 4a) (Protein 0.14) | *Triticum aestivum* | 146 | MAARPMLVVALLCAAAAAATAQQATNVRATYHYYR<br>PAQNNWDLGAPAVSAYCATWDASKPLSWRSKYG<br>WTAFCGPAGAHGQASCGKCLQVTNPATGAQITARI<br>VDQCANGGLDLDWDTVFTKIDTNGIGYQQGHLNVN<br>YQFVDCRD |
| 986 Wheatwin2 precursor (Pathogenesis-related protein 4b) | *Triticum aestivum* | 148 | MTMAARLMLVAALLCAAAAAATAQQATNVRATYHY<br>YRPAQNNWDLGAPAVSAYCATWDASKPLSWRSKY<br>GWTAFCGPAGAHGQAACGKCLRVTNPATGAQITA<br>RIVDQCANGGLDLDWDTVFTKIDTNGIGYQQGHLN<br>VNYQFVDCRD |
| 987 Zeamatin | *Zea mays* | 206 | AVFTVVNQCPFTVWAASVPVGGGRQLNRGESWRI<br>TAPAGTTAARIWARTGCKFDASGRGSCRTGDCGG<br>VLQCTGYGRAPNTLAEYALKQFNNLDFFDISLIDGF<br>NVPMSFLPDGGSGCSRGPRCAVDVNARCPAELRQ<br>DGVCNNACPVFKKDEYCCVGSAANDCHPTNYSRY<br>FKGQCPDAYSYPKDDATSTFTCPAGTNYKVVFCP |
| 988 Zeamatin precursor | *Zea mays* | 227 | MAGSVAIVGIFVALLAVAGEAAVFTVVNQCPFTVWA<br>ASVPVGGGRQLNRGESWRITAPAGTTAARIWARTG<br>CKFDASGRGSCRTGDCGGVLQCTGYGRAPNTLAE<br>YALKQFNNLDFFDISLIDGFNVPMSFLPDGGSGCSR<br>GPRCAVDVNARCPAELRQDGVCNNACPVFKKDEY<br>CCVGSAANDCHPTNYSRYFKGQCPDAYSYPKDDA<br>TSTFTCPAGTNYKVVFCP |

TABLE 2

Defensins

| SEQ ID NO: | Name | Organism | Sequence |
|---|---|---|---|
| 989 | HNP-1 | Human | ACYCRIPACIAGERRYGTCIYQGRLWAFCC |
| 990 | HNP-2 | Human | CYCRIPACIAGERRYGTCIYQGRLWAFCC |
| 991 | HNP-3 | Human | DCYCRIPACIAGERRYGTCIYQGRLWAFCC |
| 992 | HNP-4 | Human | VCSCRLVFCRRTELRVGNCLIGGVSFTYCCTRV |
| 993 | NP-1 | Rabbit | VVCACRRALCLPRERRAGFCRIRGRIHPLCCRR |
| 994 | NP-2 | Rabbit | VVCACRRALCLPLERRAGFCRIRGRIHPLCCRR |
| 995 | NP-3A | Rabbit | GICACRRRFCPNSERFSGYCRVNGARYVRCCSRR |
| 996 | NP-3B | Rabbit | GRCVCRKQLLCSYRERRIGDCKIRGVRFPFCCPR |
| 997 | NP-4 | Rabbit | VSCTCRRFSCGFGERASGSCTVNGVRHTLCCRR |
| 998 | NP-5 | Rabbit | VFCTCRGFLCGSGERASGSCTINGVRHTLCCRR |
| 999 | RatNP-1 | Rat | VTCYCRRTRCGFRERLSGACGYRGRIYRLCCR |
| 1000 | Rat-NP-3 | Rat | CSCRYSSCRFGERLLSGACRLNGRIYRLCC |
| 1001 | Rat-NP-4 | Rat | ACTCRIGACVSGERLTGACGLNGRIYRLCCR |
| 1002 | GPNP | Guinea pig | RRCICTTRTCRFPYRRLGTCIFQNRVYTFCC |

B. Growth Factors

In some embodiments of the present invention, trophic factor combinations for treating injured nervous systems comprise one or more growth factors. Growth factors useful in the present invention include, but are not limited to, the following broad classes of cytoactive compounds: Insulin, Insulin like growth factors such as IGF-I, IGF-IB, IGF-II, and IGF-BP; Heparin-binding growth factors such as Pleiotrophin (NEGF1) and Midkine (NEGF2); PC-cell derived growth factors (PCDGF); Epidermal Growth Factors such as α-EGF and β-EGF; EGF-like molecules such as Keratinocyte-derived growth factor (which is identical to KAF, KDGF, and amphiregulin) and vaccinia virus growth factor (VVGF); Fibroblast Growth Factors such as FGF-1 (Basic FGF Protein), FGF-2 (Acidic FGF Protein), FGF-3 (Int-2), FGF-4 (Hst-1), FGF-5, FGF-6, and FGF-7 (identical to KGF); FGF-Related Growth Factors such as Endothelial Cell Growth Factors (e.g., ECGF-α and ECGF-β); FGF- and ECGF-Related Growth Factors such as Endothelial cell stimulating angiogenesis factor and Tumor angiogenesis factor, Retina-Derived Growth Factor (RDGF), Vascular endothelium growth factors (VEGF, VEGF-B, VEGF-C, and VEGF-D), Brain-Derived Growth Factor (BDGF A- and -B), Astroglial Growth Factors (AGF 1 and 2), Omentum-derived factor (ODF), Fibroblast-Stimulating factor (FSF), and Embryonal Carcinoma-Derived Growth Factor; Neurotrophic Growth Factors such as α-NGF, β-NGF, γ-NGF, Brain-Derived Neurotrophic Factor (BDNF), Neurotrophin-3, Neurotrophin-4, and Ciliary Nuerotrophic Factor (CNTF); Glial Growth Factors such as GGF-I, GGF-II, GGF-III, Glia Maturation Factor (GMF), and Glial-Derived Nuerotrophic Factor (GDNF); Organ-Specific Growth Factors such as Liver Growth Factors (e.g., Hepatopoietin A, Hepatopoietin B, and Hepatocyte Growth Factors (HCGF or HGF), Prostate Growth Factors (e.g., Prostate-Derived Growth Factors [PGF] and Bone Marrow-Derived Prostate Growth Factor), Mammary Growth Factors (e.g., Mammary-Derived Growth Factor 1 [MDGF-1] and Mammary Tumor-Derived Factor [MTGF]), and Heart Growth Factors (e.g., Nonmyocyte-Derived Growth Factor [NMDGF]); Cell-Specific Growth Factors such as Melanocyte Growth Factors (e.g., Melanocyte-Stimulating Hormone [α-, β-, and γ-MSH] and Melanoma Growth-Stimulating Activity [MGSA]), Angiogenic Factors (e.g., Angiogenin, Angiotropin, Platelet-Derived ECGF, VEGF, and Pleiotrophin), Transforming Growth Factors (e.g., TGF-α, TGF-β, and TGF-like Growth Factors such as TGF-$\beta_2$, TGF-$\beta_3$, TGF-e, GDF-1, GDF-9, CDGF and Tumor-Derived TGF-β-like Factors), ND-TGF, and Human epithelial transforming factor [h-TGFe]); Regulatory Peptides with Growth Factor-like Properties such as Bombesin and Bombesin-like peptides (e.g., Ranatensin, and Litorin], Angiotensin, Endothelin, Atrial Natriuretic Factor, Vasoactive Intestinal Peptide, and Bradykinin; Cytokines such as connective tissue growth factor (CTGF), the interleukins IL-1 (e.g., Osteoclast-activating factor (OAF), Lymphocyte-activating factor (LAF), Hepatocyte-stimulating factor (HSF), Fibroblast-activating factor (FAF), B-cell-activating factor (BAF), Tumor inhibitory factor 2 (TIF-2), Keratinocyte-derived T-cell growth factor (KD-TCGF)), IL-2 (T-cell growth factor (TCGF), T-cell mitogenic factor (TCMF)), IL-3 (e.g., Hematopoietin, Multipotential colony-stimulating factor (multi-CSF), Multilineage colony-stimulating activity (multi-CSA), Mast cell growth factor (MCGF), Erythroid burst-promoting activity (BPA-E), IL-4 (e.g., B-cell growth factor I (BCGF-I), B-cell stimulatory factor 1 (BSF-1)), IL-5 (e.g., B-cell growth factor II (BCGF-II), Eosinophil colony-stimulating factor (Eo-CSF), Immunoglobulin A-enhancing factor (IgA-EF), T-cell replacing factor (TCRF)), IL-6 (B-cell stimulatory factor 2 (BSF-2), B-cell hybridoma growth factor (BCHGF), Interferon $\beta_2$ (IFN-B), T-cell activating factor (TAF), IL-7 (e.g., Lymphopoietin 1 (LP-1), Pre-B-cell growth factor (pre-BCGF)), IL-8 (Monocyte-derived neutrophil chemotactic factor (MDNCF), Granulocyte chemotatic factor (GCF), Neutrophil-activating peptide 1 (NAP-1), Leukocyte adhesion inhibitor (LAI), T-lymphocyte chemotactic factor (TLCF)), IL-9 (e.g., T-cell growth factor III (TCGF-III), Factor P40, MegaKaryoblast growth factor (MKBGF), Mast cell growth enhancing activity (MEA or MCGEA)), IL-10 (e.g., Cytokine synthesis inhibitory factor (CSIF)), IL-11 (e.g., Stromal cell-derived cytokine (SCDC)), IL-12 (e.g., Natural killer cell stimulating factor (NKCSF or NKSF), Cytotoxic lymphocyte maturation factor (CLMF)), TNF-α (Cachectin), TNF-β (Lymphotoxin), LIF (Differentiation-inducing factor (DIF), Differentiation-inducing activity (DIA), D factor, Human interleukin for DA cells (HILDA), Hepatocyte stimulating factor III (HSF-III), Cholinergic neuronal differentiation factor (CNDF), CSF-1 (Macrophage colony-stimulating factor (M-CSF)), CSF-2 (Granulocyte-macrophage colony-stimulating factor (GM-CSF)), CSF-3 (Granulocyte colony-stimulating factor (G-CSF)), and erythropoietin; Platelet-derived growth factors (e.g., Placental growth factor (PlGF), PDGF-A, PDGF-B, PDGF-AB, p28-sis, and p26-cis), and Bone Morphogenetic proteins (e.g., BMP and BMP-15), neuropeptides (e.g., Substance P, calcitonin gene-regulated peptide, and neuropeptide Y), and neurotransmitters (e.g., norepinephrine and acetylcholine).

Suitable growth factors may be obtained from commercial sources, purified from natural sources, or be produced by recombinant methods. Recombinant growth factors can be produced from wild-type coding sequences or from variant sequences that encode functional growth factors. Suitable growth factors also include analogs that may be smaller peptides or other molecules having similar binding and biological activity as the natural growth factors. Methods for producing growth factors are described in U.S. Pat. Nos. 5,183,805; 5,218,093; 5,130,298; 5,639,664; 5,457,034; 5,210,185; 5,470,828; 5,650,496; 5,998,376; and 5,410,019; all of which are incorporated herein by reference.

C. Neurotrophins

The trophic factor combinations provided herein also can include one or more neurotrophic growth factors such as Brain-Derived Neurotrophic Factor (BDNF), Neurotrophin-3, Neurotrophin-4, and Ciliary Nuerotrophic Factor (CNTF).

Nerve growth factors, such as α-NGF, β-NGF, γ-NGF, and the like, are neurotrophins. In an embodiment, the trophic factor combination does not include a nerve growth factor, which results in lessened pain.

D. Neuropeptides

The trophic factor combinations provided herein also can include one or more neuropeptides, e.g., PBAN-type neuropeptides (e.g., Diapause hormone homolog (DH); Alpha-SG neuropeptide (MAB-alpha-NP); Beta-SG neuropeptide (MAB-beta-NP)); Pheromone biosynthesis activating neuropeptide (M); PBAN-type neuropeptides (e.g., Diapause hormone (DH); Alpha-SG neuropeptide (Alpha-SGNP); Beta-SG neuropeptide (Beta-SGNP); Pheromone biosynthesis activating neuropeptide I (PBAN-I) (BoM)); Neuropeptides B/W receptor type 2 (G protein-coupled receptor 8); Neuropeptides B/W receptor type 1 (G protein-coupled receptor 7); Neuropeptides B/W receptor type 1 (G protein-coupled receptor 7) (Fragment); neuropeptides [similarity]; Glucagon-family neuropeptides (e.g., Growth hormone-releasing factor (GRF) (Growth hormone-releasing hormone) (GHRH); Pituitary adenylate cyclase activating polypeptide (PACAP)); Pol-RFamide neuropeptides; Antho-RFamide neuropeptides type 1; LWamide neuropeptides (e.g., LWamide I; Metamorphosin A (LWamide II) (MMA); LWamide III; LWamide IV; LWamide V; LWamide VI; LWamide VII; LWamide VIII; LWamide IX); Antho-RFamide neuropeptides type 2; Glucagon-family neuropeptides (e.g., Growth hormone-releasing factor (GRF) (Growth hormone-releasing hormone) (GHRH); Pituitary adenylate cyclase activating polypeptide-27 (PACAP-27) (P)); Glucagon-family neuropeptides (e.g., Growth hormone-releasing factor (GRF) (Growth hormone-releasing hormone) (GHRH); Pituitary adenylate cyclase activating polypeptide-27 (PACAP-27) (P)); LWamide neuropeptides (e.g., LWamide I; LWamide II; LWS); Glucagon-family neuropeptides (e.g., Growth hormone-releasing factor (GRF) (Growth hormone-releasing hormone) (GHRH); Pituitary adenylate cyclase activating polypeptide (PACAP)]; FMRFamide-like neuropeptides); PBAN-type neuropeptides (e.g., Diapause hormone homolog (DH); Alpha-SG neuropeptide; Beta-SG neuropeptide; Pheromone biosynthesis activating neuropeptide (AgI-PBAN); Gamma-SG neuropeptid; FMRFamide-related neuropeptides; Myomodulin neuropeptides (e.g., GLQMLRL-amide; QIPMLRL-amide; SMSMLRL-amide; SLSMLRL-amide; Myomodulin A (PMSMLRL-amide)); FMRFamide neuropeptides; neuropeptides (e.g., Substance P, calcitonin gene-regulated peptide, and neuropeptide Y); LWamide neuropeptides (e.g., LWamide I; LWamide II; LWamide III; LWamide IV; LWamide V; LWamide VI; Metamorphosin A (MMA); Mwamide) (Fragment); PBAN-type neuropeptides (e.g., Diapause hormone homolog (DH); Alpha-SG neuropeptide; Beta-SG neuropeptide); Pheromone biosynthesis activating neuropeptide (HeA-PBAN); Gamma-SG neuropeptid; Antho-RFamide neuropeptides; Neuropeptides capa receptor (Cap2b receptor); Neuropeptides B/W receptor type 2 (G protein-coupled receptor 8); Neuropeptides B/W receptor type 1 (G protein-coupled receptor 7); FMRFamide-like neuropeptides [e.g., Neuropeptide AF10 (GFG-DEMSMPGVLRF-amide); Neuropeptide AF20 (GMPGV-LRF-amide); Neuropeptide AF3 (AVPGVLRF-amide); Neuropeptide AF4 (GDVPGVLRF-amide); N PBAN-type neuropeptides [e.g., Diapause hormone homolog (DH); Alpha-SG neuropeptide; Beta-SG neuropeptide; Pheromone biosynthesis activating neuropeptide (HeZ-PBAN); Gamma-SG neuropeptid; FMRFamide neuropeptides type FMRF-1 (Fragment); Abdominal ganglion neuropeptides L5-67 (e.g., Luqin; Luqin-B; Luqin-C; Proline-rich mature peptide (PRMP)); FMRFamide neuropeptides type FMRF-2; FMR-Famide neuropeptides type FMRF-4 (Fragment); Myomodulin neuropeptides (e.g., Myomodulin A (MM-A) (PMSM-LRL-amide) (Neuron B16 peptide); Myomodulin B (MM-B) (GSYRMMRL-amide); Myomodulin D (MM-D) (GLSM-LRL-amide); Myomodulin F (MM-F); LWamide neuropeptides (e.g., LWamide I; LWamide II; Metamorphosin A (MMA); Iwamide) (Fragment) (Substance P, calcitonin gene-regulated peptide, and neuropeptide Y.)

E. Other Components

The trophic factor combinations can be used with various delivery systems. In some embodiments, the trophic factor combination is mixed with a viscous substance to increase the viscosity of the combination. The increased viscosity retains the trophic factor combination at the site of the injury longer than it would be retained in the absence of the viscous substance. The viscous substance can be, for example, a polysaccharide, such as hyaluronic acid.

In another embodiment, the trophic factor combination is delivered in a slow release formula, such as in a matrix, for example, a woundhealing matrix, either with or without a viscous substance. In an embodiment, the matrix is a hydrogel, such as a hydrogel disclosed in U.S. Patent Application No. US 20030083389A1, which describes hydrogels wherein a polymer matrix is modified to contain a bifunctional poly (alkylene glycol) molecule covalently bonded to the polymer matrix. The hydrogels can be cross-linked using, for example, glutaraldehyde. The hydrogels can also be crosslinked via an interpenetrating network of a photopolymerizable acrylates. In one embodiment of the invention, the components of the trophic factor combination are incorporated into the hydrogel, for example, through covalent bonds to poly(alkylene glycol) molecules of the hydrogel or through entertainment within the hydrogel. In other embodiments, the matrix is a collagen gel matrix, which can be impregnated with a trophic factor combination. Other matrices can also be used.

The trophic factor combination can also be delivered in a base solution, such as UW solution (DuPont Critical Care, Waukegan, Ill.), or other base solutions.

The neurochemical combinations can be used in conjunction with cell therapy, where transfected cells are produced to release the ingredients and obtain continual delivery of a trophic factor combination. For example, embryonic or adult stem cells can be modified to express trophic factors, antimicrobial peptides, and other relevant neurochemicals, to deliver the trophic factor combination endogenously to the injured spinal cord. In the case of genetically modified cell transplants, the transfected cells can be tagged with cell surface antigens so that the cells can be controlled. For example, antibodies targeting the specific antigen could be used to kill the implanted cells after therapeutic results have been achieved.

Delivery of the neurochemical combinations can also be achieved by media with spaced supports, such as sponges, gels, or biopolymers.

F. Exemplary Formulations

A trophic factor combination includes one or more antimicrobial peptide and/or one or more substance having an antimicrobial peptide effect, alone or with one or more of the following trophic factors: growth factors, neuropeptides, and neurotrophins. Another trophic factor combination includes a viscous substance, such as hyaluronic acid, among others. Another trophic factor combination includes other cytoactive compounds, such as one or more cytokine and/or one or more chemokine. Non-limiting examples of these trophic factor combinations are provided in Tables 3a-3h below. It will be recognized that the trophic factor combinations can comprise one or more antimicrobial polypeptides (e.g., a defensin such as BNP-1). The trophic factor combinations described below can also comprise one or more trophic factors above. Accordingly, in some preferred embodiments, the trophic factor combination is supplemented with one or more of the following trophic factors: trehalose (Sigma, St. Louis Mo.; e.g., about 15 mM), substance P (Sigma; e.g., about 10 μg/ml), IGF-1 (Collaborative Biologicals; e.g., about 10 ng/ml), EGF (Sigma; e.g., about 10 ng/ml), and BDNF (2 μg/ml). In some preferred embodiments, the trophic factor combination is also supplemented with insulin (1-200 units, preferably 40 units) prior to use. In some embodiments, an antimicrobial polypeptide is not included in the trophic factor combination.

In some exemplary embodiments, EGF and/or IGF-1 are included in the trophic factor combination at a concentration of about 1 ng/ml to about 100 ng/ml, most preferably about 10 ng/ml. In other exemplary embodiments, substance P is included at a concentration of about 0.1 μg/ml to about 100 μg/ml, most preferably about 2.5 μg/ml.

It will be recognized that the Tables below provide formulations that are exemplary and non-limiting. For example, alterations in the specific substances used and the number of those substances are all within the scope of the invention. In some embodiments, the antimicrobial polypeptide and/or substance having an antimicrobial peptide effect and/or one or more trophic factor, are provided in stable form that can be reconstituted. Methods for stabilization include, for example, lyophilization. In embodiments where the antimicrobial polypeptide and/or one or more growth factors are provided in lyophilized form, they can conveniently reconstituted prior to use, for example, in sterile water or in an aliquot of a base medium (e.g., UW solution), prior to addition to a base medium (e.g., hyaluronic acid, UW solution).

Alternatively, the at least one microbial polypeptide and/or one or more trophic factor can be provided as a separate composition (i.e., a "bullet") that is added to a base medium. In preferred embodiments, the bullet contains an antimicrobial peptide and/or a substance having an antimicrobial peptide effect and/or one or more trophic factor as described above. In some embodiments, the bullet contains an antimicrobial peptide and/or a substance having an antimicrobial peptide effect and/or one or more of the trophic factor as described above in concentrations that provide the appropriate concentration when added to a specific volume of the base medium, where used.

TABLE 3a

| Component Type | Substance |
| --- | --- |
| Antimicrobial peptide | BNP-1 |

TABLE 3b

| Component Type | Substance |
| --- | --- |
| Antimicrobial peptide | BNP-1 |
| Growth factor | IGF-1 |

TABLE 3c

| Component Type | Substance |
| --- | --- |
| Antimicrobial peptide | BNP-1 |
| Neuropeptide | Substance P |

TABLE 3d

| Component Type | Substance |
| --- | --- |
| Antimicrobial peptide | BNP-1 |
| Neurotrophin | BDNF |

TABLE 3e

| Component Type | Substance |
| --- | --- |
| Antimicrobial peptide | BNP-1 |
| Growth factor | IGF-1 |
| Neuropeptide | Substance P |

TABLE 3f

| Component Type | Substance |
| --- | --- |
| Antimicrobial peptide | BNP-1 |
| Growth factor | IGF-1 |
| Neurotrophin | BDNF |

TABLE 3g

| Component Type | Substance |
| --- | --- |
| Antimicrobial peptide | BNP-1 |
| Neuropeptide | Substance P |
| Neurotrophin | BDNF |

TABLE 3h

| Component Type | Substance |
| --- | --- |
| Antimicrobial peptide | BNP-1 |
| Growth factor | IGF-1 |
| Neuropeptide | Substance P |
| Neurotrophin | BDNF |

It is contemplated that the trophic factor combination can be provided in a pre-formulated form, such as in a kit format. The kit can include (1) at least one of an antimicrobial peptide and a substance having an antimicrobial peptide effect and (2) a neurotrophin. The kit can also include a viscous substance. At least one of a growth factor and a neuropeptide can also be included.

II. Uses of Trophic Factor Combinations and Their Individual Components

It is contemplated that the trophic factor combinations and their individual components described above may be utilized in a variety of procedures related to injury to the nervous system and other medical procedures. It is contemplated that the trophic factor combinations and their individual components can be used for the treatment of any part of the nervous system, including the central nervous system and the peripheral nervous system.

In one embodiment, the trophic factor combinations or one or more of their individual components are used during surgery of the disc and/or other portions of the nervous system. In an embodiment, a trophic factor combination or one or more of their individual components applied to surgical hardware and/or other implants, such as surgical screws, plates, pins, clamps, wires, pins, rods, nails, probes, spinal fixation devices, and the like. In another embodiment, a trophic factor combination or one or more of their individual components is applied directly during surgery, such as to a surgical opening, for example, an incision, a section, or any other opening. In one embodiment, a trophic factor combination or one or more of their individual components is applied to one or more tissue, nerve, organ, or cavity. A trophic factor combination or one or more of their individual components can also be applied to a surgical instrument such that when the instrument is used, the trophic factor combination or one or more of their individual components is delivered to injury and/or surrounding tissue, fluid, organ, and the like.

In use, an injury to the nervous system is identified. At least one component of the trophic factor combination is applied to the injury to the nervous system.

In some embodiments, the trophic factor combinations can be utilized to reduce body weight loss post injury in injured animals treated with the combination when compared to injured animals not treated with the trophic factor combination. Preferably, the decrease in loss of body weight is improved by at least 25% and more preferably by at least 50% as compared to animals not receiving the trophic factor combination. In some embodiments, the trophic factor combinations are used to strengthen motor recovery in injured animals treated with the trophic factor combination when compared to injured animals not treated with the trophic factor combination. In some embodiments, the trophic factor combinations are used to increase evoked potential amplitudes in injured animals treated with the trophic factor combination when compared to injured animals not treated with the trophic factor combination. In some embodiments, the trophic factor combinations are used to lower the current required to evoke a response (threshold current) in injured animals treated with the trophic factor combination when compared to injured animals not treated with the trophic factor combination. Application of the trophic factor combination according to the invention can also have at least one of the following additional effects: reduced pain in the animal, a neuroprotective effect, triggered neuronal plasticity, reduced inflammation, and growth of new cells.

EXAMPLES

The following examples serve to illustrate certain preferred embodiments and aspects of the present invention and are not to be construed as limiting the scope thereof.

Example 1

Materials and Methods

Experiments were performed on 3-5 month old male Sprague-Dawley (SD) and Lewis rats that were housed individually with free access to food and water. Rats were placed into four groups: 1) spinally injured SD rats without a trophic factor combination administered (n=8), 2) spinally injured SD rats with a trophic factor combination (n=2); 3) spinally injured Lewis rats without a trophic factor combination administered (n=5), and 4) spinally injured Lewis rats with a trophic factor combination administered (n=2).

Spinal cord injury. Rats were anesthetized with medetomidine (75 µg/kg i.m.) and isoflurane in oxygen. After orotracheal intubation, anesthesia was maintained with isoflurane in oxygen and rats were mechanically ventilated. A laminectomy was made at the second cervical vertebral level to allow the second cervical spinal segment and the cranial segment of the third cervical spinal segment to be exposed. A 1-mm-long left-sided hemisection was made in the cranial segment of $C_2$ and the section aspirated with a fine tipped glass pipette. The surgical wound was closed using standard techniques. All animals were allowed to recover and received atipamezole (0.1 mg/kg i.v.) to antagonize the anesthetic effects of medetomidine. Buprenorphine (50 µg/kg i.v.) and carprofen (5 mg/kg i.v.) were administered for postsurgical pain control. Analgesics were repeated as required over the next 2 days.

Trophic Factor Combination. The trophic factor combination (also referred to as the trophic factor combination) was made by adding 10 ug of BNP-1 (bactenecin), 100 ng of insulin-like growth factor (IGF-1), and 25 mg of Substance P to 200 ul of distilled water.

Trophic factor combination administration. Prior to closure of the surgical wound, hyaluronic acid (Hylartin V, sodium hyalurate) (10%) was added to the neurotrophin mixture to thicken the solution and improve retention at the site of spinal injury. Two ug of BDNF was added to 0.4-0.45 ml of the mixture. The mixture (0.4-0.45 ml) was then administered using a syringe and 22-gauge needle into the hemisection cavity. The wound was closed immediately after injection.

Experimental preparation. Two weeks after surgical spinal injury, respiratory motor output was measured from both phrenic nerves using two distinct experimental techniques. First, spontaneous (brain-stem driven) phrenic motor activity was measured in anesthetized rats during standardized conditions. Second, spontaneous activity was removed by hyperventilating the rats and evoke potentials were elicited by spinal stimulation to evaluate the strength of the spinal pathways contributing to motor recovery.

Isoflurane anesthesia was induced in a closed chamber and maintained (2.5-3.5%) via nose cone while rats were tracheotomized. Rats were mechanically ventilated following tracheal cannulation. Following femoral venous catheterization rats were converted to urethane anesthesia (1.6 g/kg) then bilaterally vagotomized and paralyzed with pancuronium bromide (2.5 mg/kg, i.v.). Blood pressure was monitored via a femoral arterial catheter and pressure transducer (Gould P23ID, Valley View, Ohio). End-tidal $CO_2$ was monitored with a rapidly responding analyzer (Novametrix, Wallingford, Conn.). Arterial partial pressures of $O_2$ ($PaO_2$) and $CO_2$ ($PaCO_2$) as well as pH were determined from 0.2 ml blood samples (ABL-500, Radiometer, Copenhagen, Denmark); unused blood was returned to the animal. Rectal temperature was maintained (37-39° C.) with a heated table. Phrenic nerves were isolated with a dorsal approach, cut distally, desheathed, bathed in mineral oil and placed on bipolar silver electrodes. Nerve activity was amplified (1000-10,000×) and filtered (100-10,000 Hz bandpass; model 1800, A-M Systems, Carlsborg, Wash.).

Spontaneous phrenic motor output. In all rats, the $CO_2$ apneic threshold for inspiratory activity in the phrenic nerve contralateral to hemisection was determined after waiting a minimum of one hour following conversion to urethane anesthesia. This delay allowed blood pressure and respiratory motor output to stabilize. The procedure to establish the apneic threshold began by increasing the ventilator frequency until inspiratory activity ceased. Ventilator rate was then decreased slowly until inspiratory activity re-appeared. The end-tidal $CO_2$ partial pressure ($P_{ET}CO_2$) corresponding to the onset of inspiratory bursting was defined as the $CO_2$ apneic threshold. $P_{ET}CO_2$ was maintained 3 mmHg above the apneic threshold by adjusting the ventilator pump rate and inspired $CO_2$ content. After the $CO_2$ apneic threshold and baseline $PaCO_2$ levels were established, 30-45 minutes were allowed to attain stable baseline conditions.

Evoked phrenic potentials. Rats were hyperventilated ($PaCO_2$<30 mmhg) to prevent spontaneous inspiratory efforts. A monopolar tungsten electrode (5 MΩ, A-M Systems) was inserted contralateral to the spinal hemisection and adjacent to the C2 dorsal roots. The electrode tip was placed in or in close proximity to the ventrolateral finiculus (1.8-2.3 mm below the dorsal root entry zone). Electrode position was selected by maximizing the amplitude of a short latency (<1.0 ms) evoked potential in the phrenic nerve contralateral to SCI. Stimulus-response relationships were obtained by applying current pulses (20-1000 μA, 0.2 ms duration) with a stimulator (model S88, Grass Instruments, Quincy, Mass.) and stimulus isolation unit (model PSIU6E, Grass Instruments). Phrenic potentials were digitized and analyzed with P-CLAMP software (Axon Instruments, Foster City, Calif.).

Results:

Body Weight. Body weight decreased by 2 weeks post-injury in rats that had received a spinal hemisection (FIG. 1). Decreased body mass may represent disuse atrophy of skeletal muscles or inadequate caloric intake. Reduced food consumption may occur secondary to spinal cord injury because of motor paresis, reduced locomotor coordination, and/or decreased appetite. Spinally injured rats that received the trophic factor combination had significantly less reduction in body weight compared to the control group (FIG. 1).

Figure 2:
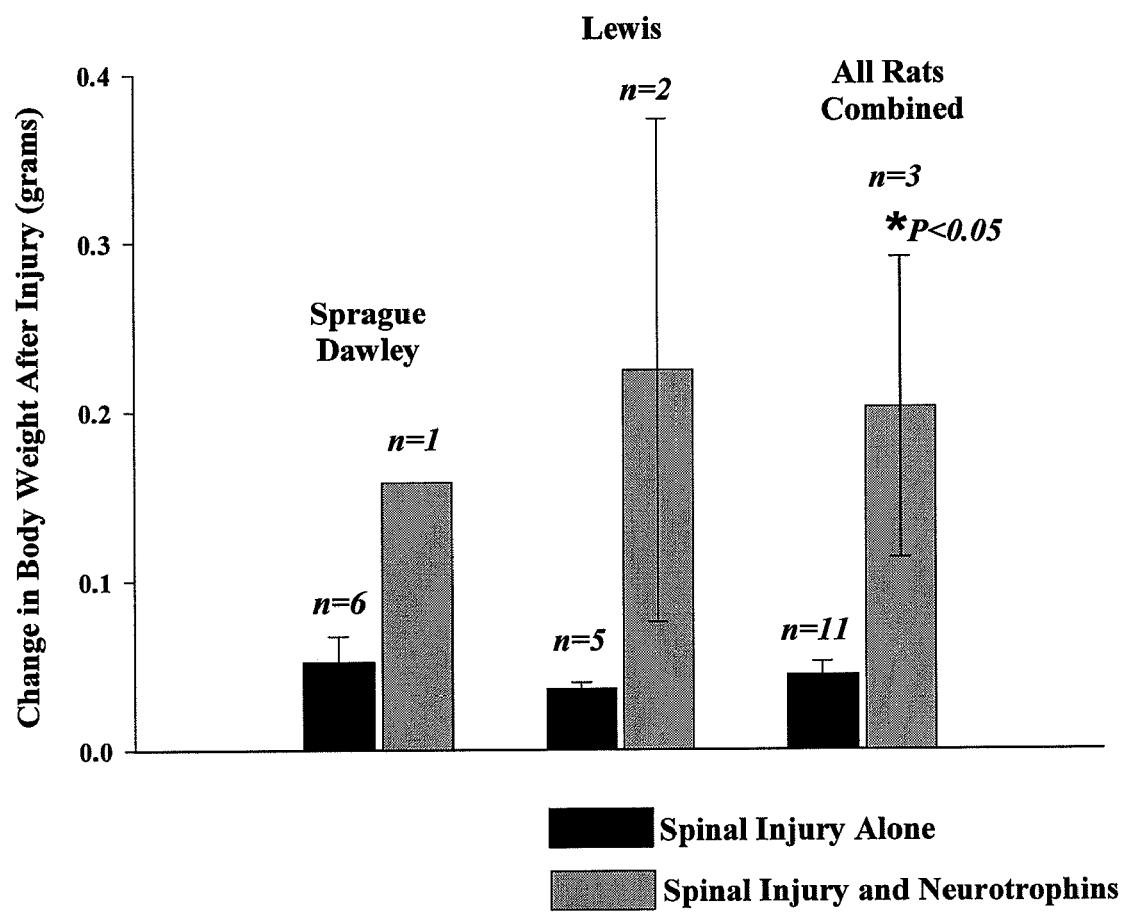
FIG. 2 is a graph showing peak neurogram voltages from the phrenic nerve during inspiration on the side of injury (Y-axis) at 2 weeks post-injury in two strains of rats, Sprague Dawley and Lewis (X-axis). For each strain of rats, neurogram voltages are shown for spinal injury alone (black bar) and for spinal injury and the trophic factor combination (grey bar). In addition, corresponding data are shown for all rats combined.

Spontaneous Phrenic Nerve Activity. Spontaneous recovery of phrenic motor function on the injured side was evident as inspiratory bursts that were in synchrony with phrenic motor activity on the uninjured side. Phrenic motor recovery was present in all spinally injured rats regardless of treatment. However, the magnitude of this recovery differed between groups (FIG. 2). Administration of the trophic factor combination at the time of injury strengthened motor recovery at 2 weeks post-injury as evident by the significantly larger peak inspiratory voltage during baseline recording conditions (FIG. 2). Phrenic peak inspiratory voltage is correlated to tidal volume. Although tidal volume was not measured in these rats, it is reasonable to assume that the increased peak inspiratory voltage would translate to larger tidal volumes in these animals compared to spinally injured rats that did not receive the trophic factor combination.

Figure 3:
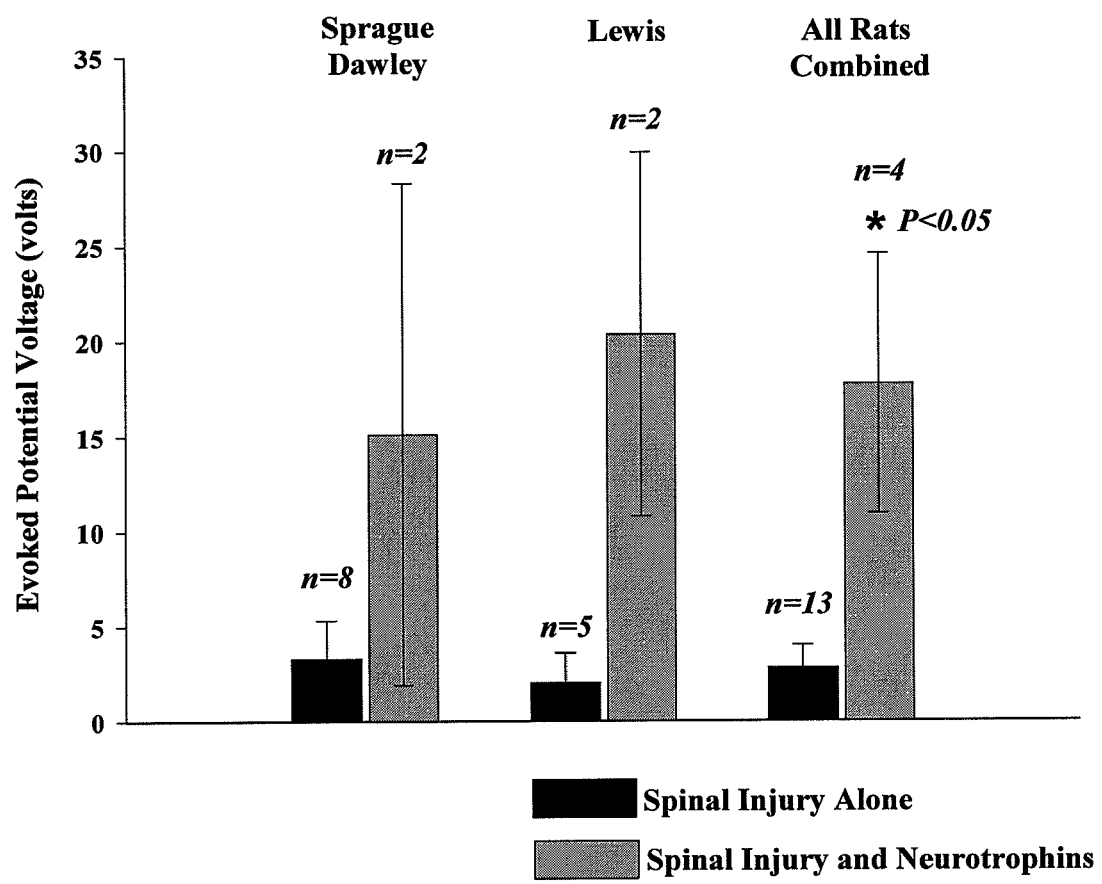
FIG. 3 is a graph showing evoked potential voltage (in volts) from the phrenic neurogram on the side of injury at 2 weeks post-injury (Y-axis) in two strains of rats, Sprague Dawley and Lewis (X-axis). The stimulating current was 1000 uA. For each strain of rats, evoked potential voltages are shown for spinal injury alone (black bar) and for spinal injury and the trophic factor combination (grey bar). In addition, corresponding data are shown for all rats combined.

Evoked Phrenic Nerve Potentials. Evoked potentials were recorded from the phrenic nerve on the side of injury (FIG. 3). Consistent with the effects of treatment on spontaneous phrenic nerve activity data, administration of trophic factor combination at the time of injury significantly increased evoked potential amplitudes compared to rats that only received a spinal injury.

Figure 4:
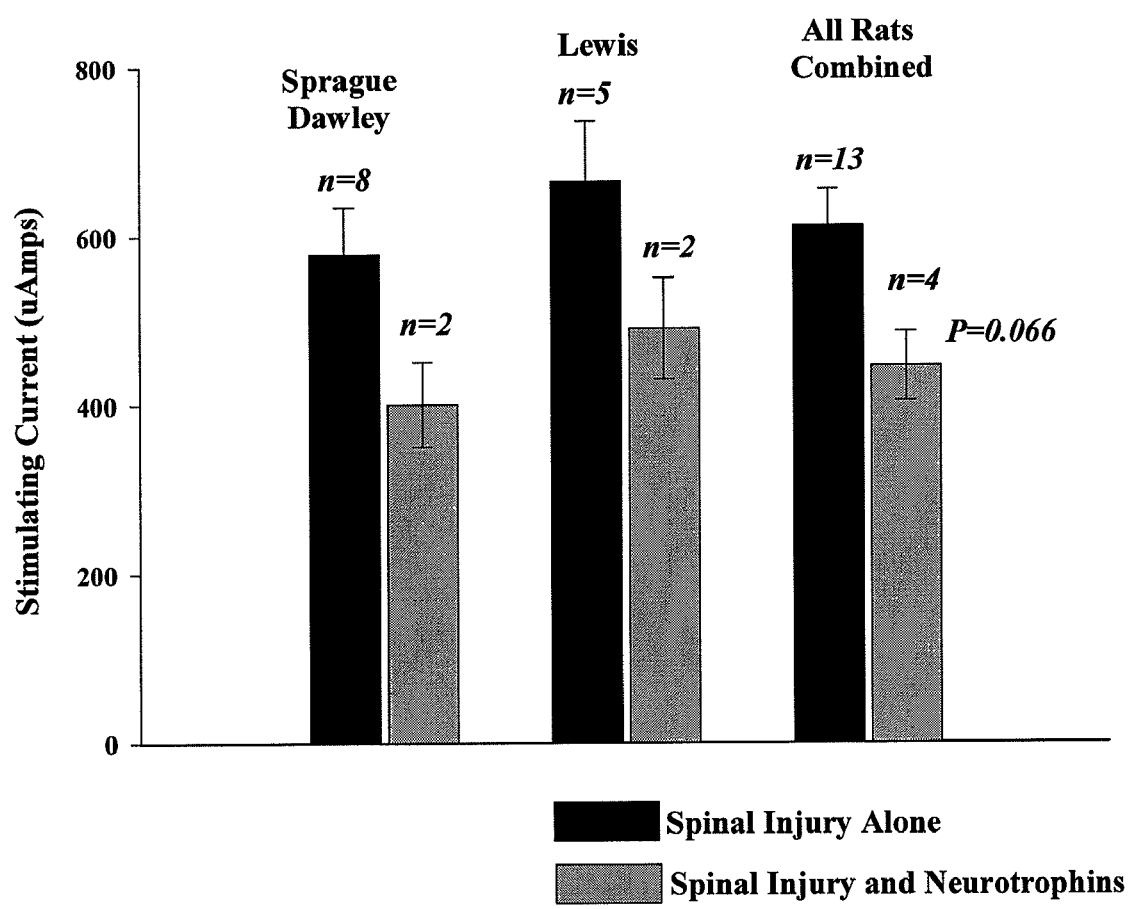
FIG. 4 is a graph showing the stimulating current (in uAmps) required to evoke potentials in the phrenic nerve on the side of injury at 2 weeks post-injury (Y-axis) in two strains of rats, Sprague Dawley and Lewis (X-axis). For each strain of rats, stimulating currents are shown for spinal injury alone (black bar) and for spinal injury and the trophic factor combination (grey bar). In addition, corresponding data are shown for all rats combined.

In addition, a strong trend existed for the current required to evoke a response (threshold current) to be lower after trophic factor combination administration compared to the control group (FIG. 4). Collectively, these data suggest that the trophic factor combination strengthens motor recovery via a spinal mechanism that strengthens existing synaptic pathways onto phrenic motoneurons.

Example 2

Figure 5:
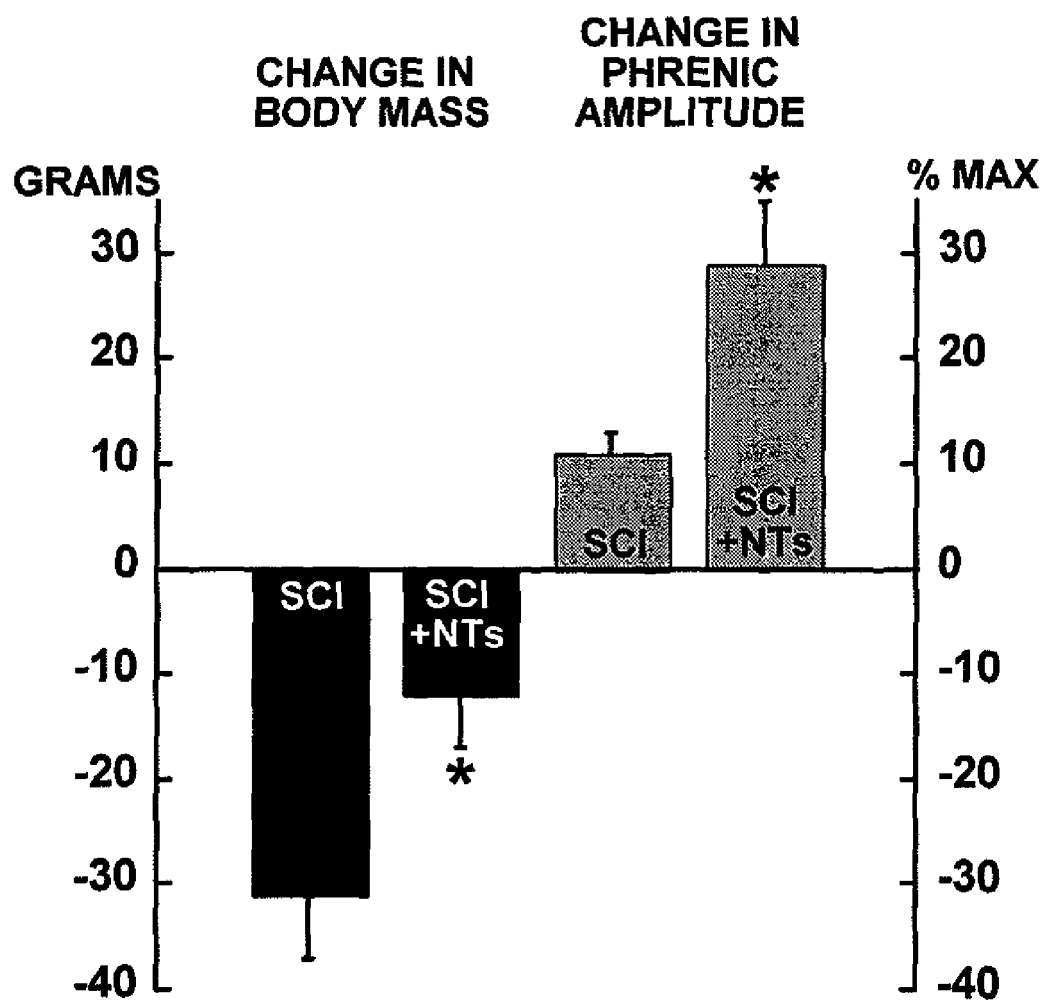
FIG. 5 is a graph showing the change in body mass in grams at 2 weeks post-injury (Y-axis) in different Lewis rats (X-axis). The body weight is shown for spinal injury alone (SCI) and for spinal injury and a trophic factor combination made in accordance with the invention (SCI+NTs).

This study was performed to determine whether application of a trophic factor combination can improve motor function after spinal cord injury (SCI). In this study, the trophic factor combination of Example 1 was applied and included insulin-like growth factor (IGF-1), brain-derived neurotrophic factor (BDNF), bactenesin (BNP-1), and substance P. The trophic factor combination was applied to test whether this combination would augment spontaneous respiratory motor recovery in a well-defined model of high cervical incomplete spinal cord injury (C2 hemisection). The trophic factor combination was applied to the injured spinal cord at the time of surgical injury. At 2 weeks post-injury, respiratory motor output was recorded bilaterally from phrenic nerves in urethane anesthetized, vagotomized, and mechanically ventilated spinally injured Lewis male rats (SCI-only: n=6; SCI+ trophic factor combination; n=6, with some of these rats being the same as the rats in Example 1). Body weight decreased in all rats after injury. However, the change in body weight was significantly less after trophic factor combination treatment (see FIG. 5; $p<0.05$). Spontaneous recovery of phrenic motor output on the side of injury was present in all rats and represents activation of a latent population of bulbospinal premotor synaptic pathways to ipsilateral phrenic motoneurons that cross the spinal midline caudal to injury. The trophic factor combination increased the amplitude of phrenic inspiratory bursts on the injured side when measured as rectified and moving-averaged voltages and indexed to the maximal amplitude during hypercapnia (see FIG. 5; $p<0.05$). In contrast, the trophic factor combination did not alter phrenic motor output on the side opposite injury. Thus, combined treatment with the trophic factor combination improves phrenic motor recovery after C2 hemisection by selectively augmenting crossed spinal synaptic pathways.

Example 3

Subtractive studies. Experiments can be performed on rats in accordance with the methods described in Example 2 except that fewer than all four components, i.e., insulin-like growth factor (IGF-1), brain-derived neurotrophic factor (BDNF), bactenesin (BNP-1), and substance P, of the trophic factor combination can be used (except for one or more controls using all four components). Different components can also be used. For example, a different growth factor (and/or neurotrophin and/or neuropeptide and/or antimicrobial peptide) can be used than the one listed above. Studies can also be run using only one component, i.e., either IGF-1, BDNF, BNP-1, or substance P or any other trophic factor to determine the effects of the individual components. Studies can also be performed using combinations of two of the components and using combinations of three of the components to determine whether all four components are needed to achieve the desired results.

Example 4

Experiments can be performed on dogs having herniated discs. Traditionally, many dogs undergo surgical treatment of disc herniation, but no trophic factor combination has been administered during such surgery. Four naïve dogs can be first treated to test for unanticipated common severe negative effects of the trophic factor combination. Once this is done, 50 dogs presenting to the Veterinary Medical Teaching Hospital (VTMH) at the University of Wisconsin with severe spinal cord dysfunction can be tested.

Trophic factor combination. The trophic factor combination can be formulated of insulin like growth factor-1 (IGF-1) (10 ng/ml), substance P (2.5 µg/ml), bactenecin (1 µg/ml) and brain derived neurotrophic factor (BDNF) (2 µg/ml). The factors can be dissolved in a 1% hyaluronic acid solution. The hyaluronic acid is used in order to increase the contact time of the factors with the tissues.

Dogs that are clinical patients. Surgery can be performed under general anesthesia. A hemilaminectomy can be done at the site of the disc herniation. A 22-gauge catheter can be placed through the dura mater and arachnoid membrane and inserted in the subarachnoid space just caudal to the disc herniation. One ml of the trophic factor combination can be injected in the subarachnoid space. The surgery site can be closed routinely.

After recovery from anesthesia, intravenous lactated Ringer's solution and analgesics can be continued until the dog is able to drink on its own and does not appear painful. Neurologic examinations can be done twice a day. The dogs can be discharged to the owner when they are considered not to need pain medication, can urinate on their own, and are eating and drinking. Follow up examinations can be scheduled as appropriate clinically.

Pain or discomfort during surgery can be alleviated by maintenance of a surgical plane of anesthesia and constant rate infusion (CRI) of fentanyl 10 µg/kg/hr. The fentanyl CRI can be continued up to 12 hours post operatively at a dose of 2-5 µg/kg/hr. A Fentanyl Patch (50 mcg/hr, 5 mcg/kg/hr for total of 72 hours) can be administered as a routine postoperative treatment. Butorphanol can be further administered if the dogs demonstrate discomfort and can be given as long as clinical signs of pain, as indicated by abnormal posturing, vocalization, or discomfort upon palpation of the surgical wound site are present.

Immediately after surgery, the dogs can be monitored continuously until the animals are able to drink water on their own sufficient to maintain their hydration. After this recovery period, the animals can be checked a minimum of 3 times daily to determine if they are experiencing pain or discomfort. The dogs can be evaluated by physical exam, neurological exam, and direct palpation of the surgical wound. The dogs can receive routine recumbent care.

Dogs can be monitored post-surgically for cardiovascular stability by physical exam, pulse character, capillary refill time, heart rate, respiratory rate, and packed cell volume, if needed. Fluids can be administered if needed to maintain hydration. Postoperative discomfort can be alleviated by administration of fentanyl CRI (10 µg/kg/hr) during surgery and fentanyl CRI (2-5 µg/kg/hr) after surgery or butorphanol (0.2-0.4 mg/kg/IV or SQ) every 4-6 hours thereafter and a Fentanyl Patch (50 mcg/hr, 5 mcg/kg/hr for total of 72 hours).

Example 5

Safety trial of trophic factor combination on dogs. The toxicity of the trophic factor combination described in Example 4 was tested on dogs. Four beagle dogs were studied over a three-day period. While the dogs were anesthetized, the trophic factor combination described in Example 4 in hyaluronic acid was injected into 1) the lumbar cerebrospinal fluid (2 dogs) and 2) the cistema magna cerebrospinal fluid (2 dogs). In all four cases, the dogs recovered easily and showed no signs of toxic reactions. There was no evidence for chronic pain on neurological exam. All dogs were euthanized on the third day of the study. In summary, no adverse reactions were observed in any animal.

It is understood that the various preferred embodiments are shown and described above to illustrate different possible features of the invention and the varying ways in which these features may be combined. Apart from combining the different features of the above embodiments in varying ways, other modifications are also considered to be within the scope of the invention.

The invention is not intended to be limited to the preferred embodiments described above, but rather is intended to be limited only by the claims set out below. Thus, the invention encompasses all alternate embodiments that fall literally or equivalently within the scope of these claims.

SEQUENCE LISTING (1002 sequences)

SEQ ID NO: 1 - protein, 170 aa, Homo sapiens
MKTQRDGHSLGRWSLVLLLLGLVMPLAIIAQVLSYKEAVLRAIDGINQRSSDANLYRLLDLDPRPTMDGDPDTPKPVSFTVKETVCPRTTQQSPEDCDFKKDGLVKRCMGTVNLNQARGSFDISCDKDNKRFALLGDFFRKSKEKIGKEFKRIVQRIKDFLRNLVPRTES

SEQ ID NO: 2 - protein, 170 aa, Homo sapiens
MKTQRDGHSLGRWSLVLLLLGLVMPLAIIAQVLSYKEAVLRAIDGINQRSSDANLYRLLDLDPRPTMDGDPDTPKPVSFTVKETVCPRTTQQSPEDCDFKKDGLVKRCMGTVTLNQARGSFDISCDKDNKRFALLGDFFRKSKEKIGKEFKRIVQRIKDFLRNLVPRTES

SEQ ID NO: 3 - protein, 476 aa, Homo sapiens
MQPVMLALWSLLLLWGLATPCQELLETVGTLARIDKDELGKAIQNSLVGEPILQNVLGSVTAVNRGLLGSGGLLGGGGLLGHGGVFGVVEELSGLKIEELTLPKVLLKLLPGFGVQLSLHTKVGMHCSGPLGGLLQLAAEVNVTSRVALAVSSRGTPILILKRCSTLLGHISLFSGLLPTPLFGVVEQMLFKVLPGLLCPVVDSVLGVVNELLGAVLGLVSLGALGSVEFSLATLPLISNQYIELDINPIVKSVAGDIIDFPKSRAPAKVPPKKDHTSQVMVPLYLFNTTFGLLQTNGALDMDITPELVPSDVPLTTTDLAALLPEALGKLPLHQQLLLFLRVREAPTVTLHNKKALVSLPANIHVLFYVPKGTPESLFELNSVMTVRAQLAPSATKLHISLSLERLSVKVASSFTHAFDGSRLEEWLSHVVGAVYAPKLNVALDVGIPLPKVLNINFSNSVLEIVENAVVLTVAS

SEQ ID NO: 4 - protein, 251 aa, Homo sapiens
MTRLTVLALLAGLLASSRAGSSPLLDIVGGRKARPRQFPFLASIQNQGRHFCGGALIHARFVMTAASCFQSQNPGVSTVVLGAYDLRRRERQSRQTFSISSMSENGYDPQQNLNDLMLLQLDREANLTSSVTILPLPLQNATVEAGTRCQVAGWGSQRSGGRLSRFPRFVNVTVTPEDQCRPNNVCTGVLTRRGGICNGDGGTPLVCEGLAHGVASFSLGPCGRGPDFFTRVALFRDWIDGVLNNPGPGPA

SEQ ID NO: 5 - protein, 483 aa, Homo sapiens
MARGPCNAPRWVSLMVLVAIGTAVTAAVNPGVVVRISQKGLDYASQQGTAALQKELKRIKIPDYSDSFKIKHLGKGHYSFYSMDIREFQLPSSQISMVPNVGLKFSISNANIKISGKWKAQKRFLKMSGNFDLSIEGMSISADLKLGSNPTSGKPTITCSSCSSHINSVHVHISKSKVGWLIQLFHKKIESALRNKMNSQVCEKVTNSVSSKLQPYFQTLPVMTKIDSVAGINYGLVAPPATTAETLDVQMKGEFYSENHHNPPPFAPPVMEFPAAHDRMVYLGLSDYFFNTAGLVYQEAGVLKMTLRDDMIPKESKFRLTTKFFGTFLPEVAKKFPNMKIQIHVSASTPPHLSVQPTGLTFYPAVDVQAFAVLPNSSLASLFLIGMHTTGSMEVSAESNRLVGELKLDRLLLELKHSNIGPFPVELLQDIMNYIVPILVLPRVNEKLQKGFPLPTPARVQLYNVVLQPHQNFLLFGADVVYK

SEQ ID NO: 6 - protein, 487 aa, Homo sapiens
MRENMARGPCNAPRWVSLMVLVAIGTAVTAAVNPGVVVRISQKGLDYASQQGTAALQKELKRIKIPDYSDSFKIKHLGKGHYSFYSMDIREFQLPSSQISMVPNVGLKFSISNANIKISGKWKAQKRFLKMSGNFDLSIEGMSISADLKLGSNPTSGKPTITCSSCSSHINSVHVHISKSKVGWLIQLFHKKIESALRNKMNSQVCEKVTNSVSSKLQPYFQTLPVMTKIDSVAGINYGLVAPPATTAETLDVQMKGEFYSENHHNPPPFAPPVMEFPAAHDRMVYLGLSDYFFNTAGLVYQEAGVLKMTLRDDMIPKESKFRLTTKFFGTFLPEVAKKFPNMKIQIHVSASTPPHLSVQPTGLTFYPAVDVQAFAVLPNSSLASLFLIGMHTTGSMEVSAESNRLVGELKLDRLLLELKHSNIGPFPVELLQDIMNYIVPILVLPRVNEKLQKGFPLPTPARVQLYNVVLQPHQNFLLFGADVVYK

SEQ ID NO: 7 - protein, 111 aa, Homo sapiens
MKSLLFTLAVFMLLAQLVSGNWYVKKCLNDVGICKKKCKPEEMHVKNGWAMCGKQRDCCVPADRRANYPVFCVQTKTTRISTVTATTATTTLMMTTASMSSMAPTPVSPTG

SEQ ID NO: 8 - protein, 65 aa, Homo sapiens [sequence omitted]

SEQ ID NO: 9 - protein, 67 aa, Homo sapiens
MRIHYLLFALLFLFLVPVPGHGGIINTLQKYYCRVRGGRCAVLSCLPKEEQIGKCSTRGRKCCRRKK

SEQ ID NO: 10 - protein, 72 aa, Homo sapiens [sequence omitted]

SEQ ID NO: 11 - protein, 77 aa, Homo sapiens
MALIRKTFYFLFAMFFILVQLPSGCQAGLDFSQPFPSGEFAVCESCKLGRGKCRKECLENEKPDGNCRLNFLCCRQR

SEQ ID NO: 12 - protein, 78 aa, Homo sapiens
MALIRKTFYFLFAMFFILVQLPSGCQAGLDFSQPFPSGEFAVCESCKLGRGKCRKECLENEKPDGNCRLNFLCCRQRI

SEQ ID NO: 13 - protein, 57 aa, Homo sapiens
MRTFLFLFAVLFFLTPAKNAFFDEKCNKLKGTCKNNCGKNEELIALCQKSLKCCRTI

SEQ ID NO: 14 - protein, 65 aa, Homo sapiens
MRTFLFLFAVLFFLTPAKNAFFDEKCNKLKGTCKNNCGKNEELIALCQKSLKCCRTIQPCGSIID

SEQ ID NO: 15 - protein, 63 aa, Homo sapiens
MKIFVFILAALILLAQIFQARTAIHRALISKRMEGHCEAECLTFEVKIGGCRAELAPFCCKNR

SEQ ID NO: 16 - protein, 59 aa, Homo sapiens
MRIAVLFFTIFFFMSQVLPAKGKFKEICERPNGSCRDFCLETEIHVGRCLNSRPCCLPL

SEQ ID NO: 17 - protein, 73 aa, Homo sapiens
MRIAVLLFAIFFFMSQVLPARGKFKEICERPNGSCRDFCLETEIHVGRCLNSQPCCLPLGHQPRIESTTPKKD

SEQ ID NO: 18 - protein, 123 aa, Homo sapiens
MKLLLLALPMLVLLPQVIPAYSGEKKCWNRSGHCRKQCKDGEAVKDTCKNLRACCIPSNEDHRRVPATSPTPLSDSTPGIIDDILTVRFTTDYFEVSSKKDMVEESEAGRGTETSLPNVHHSS

SEQ ID NO: 19 - protein, 84 aa, Homo sapiens
  misc_feature (18)..(18): Xaa can be any naturally occurring amino acid
MKLLYLFLAILLAIEEPXISGKRHILRCMGNSGICRASCKKNEQPYLYCRNCQSCCLQSYMRISISGKEENTDWSYEKQWPRLP

SEQ ID NO: 20 - protein, 88 aa, Homo sapiens
MKLLYLFLAILLAIEEPVISVECWMDGHCRLLCKDGEDSIIRCRNRKRCCVPSRYLTIQPVTIHGILGWTTPQMSTTAPKMKTNITNR

SEQ ID NO: 21 - protein, 67 aa, Homo sapiens
MKLLLLTLTVLLLLSQLTPGGTQRCWNLYGKCRYRCSKKERVYVYCINNKMCCVKPKYQPKERWWPF

SEQ ID NO: 22 - protein, 43 aa, Homo sapiens
EFKRCWKGQGACQTYCTRQETYMHLCPDASLCCLSYALKPPPV

SEQ ID NO: 23 - protein, 152 aa, Homo sapiens
MLTFIICGLLTRVTKGSFEPQKCWKNNVGHCRRRCLDTERYILLCRNKLSCCISIISHEYTRRPAFPVIHLEDITLDYSDVDSFTGSPVSMLNDLITFDTTKFGETMTPETNTPETTMPPSEATTPETTMPPSETATSETMPPPSQTALTHN

SEQ ID NO: 24 - protein, 111 aa, Homo sapiens [sequence omitted]

SEQ ID NO: 25 - protein, 99 aa, Homo sapiens
MGLFMIIAILLFQKPTVTEQLKKCWNNYVQGHCRKICRVNEVPEALCENGRYCCLNIKELEACKKITKPPRPKPATLALTLQDYVTIIENFPSLKTQST

SEQ ID NO: 26 - protein, 183 aa, Homo sapiens
MKLLFPIFASLMLQYQVNTEFIGLRRCLMGLGRCRDHCNVDEKEIQKCKMKKCCVGPKVVKLIKNYLQYGTPNVLNEDVQEMLKPAKNSSAVIQRKHILSVLPQIKSTSFFANTNFVIIPNATPMNSATISTMTPGQITYTATSTKSNTKESRDSATASPPPAPPPPNILPTPSLELEEAEEQ

SEQ ID NO: 27 - protein, 70 aa, Homo sapiens
MRVLFFVFGVLSLMFTVPPGRSFISNDECPSEYYHCRLKCNADEHAIRYCADFSICCKLKIIEIDGQKKW

SEQ ID NO: 28 - protein, 37 aa, Homo sapiens
PVTCLKSGAICHPVFCPRRYKQIGTCGLPGTKCCKKP

SEQ ID NO: 29 - protein, 64 aa, Homo sapiens
MRVLYLLFSFLFIFLMPLPGVFGGIGDPVTCLKSGAICHPVFCPRRYKQIGTCGLPGTKCCKKP

SEQ ID NO: 30 - protein, 156 aa, Homo sapiens
MNILMLTFIICGLLTRVTKGSFEPQKCWKNNVGHCRRRCLDTERYILLCRNKLSCCISIISHEYTRRPAFPVIHLEDITLDYSDVDSFTGSPVSMLNDLITFDTTKFGETMTPETNTPETTMPPSEATTPETTMPPSETATSETMPPPSQTALTHN

SEQ ID NO: 31 - protein, 93 aa, Homo sapiens
MKLFLVLIILLFEVLTDGARLKKCFNKVTGYCRKKCKVGERYEIGCLSGKLCCANDEEEKKHVSFKKPHQHSGEKLSVLQDYIILPTITIFTV

SEQ ID NO: 32 - protein, 45 aa, Homo sapiens
GIINTLQKYYCRVRGGRCAVLSCLPKEEQIGKCSTRGRKCCRRKK

SEQ ID NO: 33 - protein, 95 aa, Homo sapiens
MKFLLLVLAALGFLTQVIPASAGGSKCVSNTPGYCRTCCHWGETALFMCNASRKCCISYSFLPKPDLPQLIGNHWQSRRRNTQRKDKKQQTTVTS

SEQ ID NO: 34 - protein, 47 aa, Homo sapiens
GNFLTGLGHRSDHYNCISSGGQCLYSACPIFTKIQGTCYRGKAKCCK

SEQ ID NO: 35 - protein, 41 aa, Homo sapiens
GIGDPVTCLKSGAICHPVFCPRRYKQIGTCGLPGTKCCKKP

SEQ ID NO: 36 - protein, 67 aa, Homo sapiens [sequence omitted]

SEQ ID NO: 37 - protein, 93 aa, Homo sapiens
MLTELEKALNSIIDVYHKYSLIKGNFHAVYRDDLKKLLETECPQYIRKKGADVWFKELDINTDGAVNFQEFLILVIKMGVAAHKKSHEESHKE

SEQ ID NO: 38 - protein, 114 aa, Homo sapiens
MTCKMSQLERNIETIINTFHQYSVKLGHPDTLNQGEFKELVRKDLQNFLKKENKNEKVIEHIMEDLDTNADKQLSFEEFIMLMARLTWASHEKMHEGDEGPGHHHKPGLGEGTP

SEQ ID NO: 39 - protein, 92 aa, Homo sapiens
MTKLEEHLEGIVNIFHQYSVRKGHFDTLSKGELKQLLTKELANTIKNIKDKAVIDEIFQGLDANQDEQVDFQEFISLVAIALKAAHYHTHKE

SEQ ID NO: 40 - protein, 170 aa, Homo sapiens
MKTQRNGHSLGRWSLVLLLLGLVMPLAIIAQVLSYKEAVLRAIDGINQRSSDANLYRLLDLDPRPTMDGDPDTPKPVSFTVKETVCPRTTQQSPEDCDFKKDGLVKRCMGTVTLNQARGSFDISCDKDNKRFALLGDFFRKSKEKIGKEFKRIVQRIKDFLRNLVPRTES

SEQ ID NO: 41 - protein, 255 aa, Homo sapiens
MQPLLLLLAFLLPTGAEAGEIIGGRESRPHSRPYMAYLQIQSPAGQSRCGGFLVREDFVLTAAHCWGSNINVTLGAHNIQRRENTQQHITARRAIRHPQYNQRTIQNDIMLLQLSRRVRRNRNVNPVALPRAQEGLRPGTLCTVAGWGRVSMRRGTDTLREVQLRVQRDRQCLRIFGSYDPRRQICVGDRRERKAAFKGDSGGPLLCNNVAHGIVSYGKSSGVPPEVFTRVSSFLPWIRTTMRSFKLLDQMETPL

SEQ ID NO: 42 - protein, 457 aa, Homo sapiens
MRSAAVLALLLCAGQVTALPVNSPMNKGDTEVMKCIVEVISDTLSKPSPMPVSQECFETLRGDERILSILRHQNLLKELQDLALQGAKERAHQQKKHSGFEDELSEVLENQSSQAELKEAVEEPSSKDVMEKREDSKEAEKSGEATDGARPQALPEPMQESKAEGNNQAPGEEEEEEEEATNTHPPASLPSQKYPGPQAEGDSEGLSQGLVDREKGLSAEPGWQAKREEEEEEEEEAEAGEEAVPEEEGPTVVLNPHPSLGYKEIRKGESRSEALAVDGAGKPGAEEAQDPEGKGEQEHSQQKEEEEEMAVVPQGLFRGGKSGELEQEEERLSKEWEDSKRWSKMDQLAKELTAEKRLEGQEEEEDNRDSSMKLSFRARAYGFRGPGPQLRRGWRPSSREDSLEAGLPLQVRGYPEEKKEEEGSANRRPEDQELESLSAIEAELEKVAHQLQALRRG

SEQ ID NO: 43 - protein, 94 aa, Homo sapiens
MRTIAILAAILLVALQAQAESLQERADEATTQKQSGEDNQDLAISFAGNGLSALRTSGSQARATCYCRTGRCATRESLSGVCEISGRLYRLCCR

SEQ ID NO: 44 - protein, 101 aa, Homo sapiens
MRTLTILTAVLLVALQAKAEPLQAEDDPLQAKAYEADAQEQRGANDQDFAVSFAEDASSSLRALGGSTRAFTCHCRRSCYSTEYSYGTCTVMGINHRFCCL

SEQ ID NO: 45 - protein, 100 aa, Homo sapiens
MRTLTILTAVLLVALQAKAEPLQAEDDPLQAKAYEADAQEQRGANDQDFAVSFAEDASSSLRALGSTRAFTCHCRRSCYSTEYSYGTCTVMGINHRFCCL

SEQ ID NO: 46 - protein, 65 aa, Homo sapiens
CCSPGADCSGHPRSGCFPCMGRKLGSKASRLKEKHGLLLQNTSVHCRRTSLWNLHLPGKTLGILL

SEQ ID NO: 47 - protein, 60 aa, Homo sapiens
MKIFFFILAALILLAQIFQARTAIHRALISKRMEGHCEAECLTFEVKIGGCRAELAPFCC

SEQ ID NO: 48 - protein, 52 aa, Homo sapiens
GKFKEICERPNGSCRDFCLETEIHVGRCLNSQPCCLPLGHQPRIESTTPKKD

SEQ ID NO: 49 - protein, 21 aa, Homo sapiens
SCTAIGGRCKNQCDDSEFRIS

SEQ ID NO: 50 - protein, 39 aa, Homo sapiens
KRYGRCKRDCLESEKQIDICSLPGKICCTEKLYEEDDMF

SEQ ID NO: 51 - protein, 101 aa, Homo sapiens
  misc_feature (11)..(11): Xaa can be any naturally occurring amino acid
  misc_feature (29)..(29): Xaa can be any naturally occurring amino acid
GEKKCWNRSGXCRKQCKDGEAVKDTCKNXRACCIPSNEDHRRVPATSPTPLSDSTPGIIDDILTVRFTTDYFEVSSKKDMVEESEAGRGTETSLPNVHHSS

SEQ ID NO: 52 - protein, 94 aa, Homo sapiens
SLLFTLAVFMLLAQLVSGNWYVKKCLNDVGICKKKCKPEEMHVKNGWAMCGKQRDCCVPADRRANYPVFCVQTKTTRISTVTATTATTTLMMTT

SEQ ID NO: 53 - protein, 59 aa, Homo sapiens
EQLKKCWNNYVQRHCRKICRVNEVPEALCENGRYCCLNIKELEACKKITKPPSPKQHLH

SEQ ID NO: 54 - protein, 155 aa, Homo sapiens
MKLLFPIFASLMLQYQVNTEFIGLRRCLMGLGRCRDHCNVDEKEIQKCKMKKCCVGPKVVKLIKNYLQYGTPNVLNEDVQEMLKPAKNSSAVIQRKHILSVLPQIKSTSFFANTNFVIIPNATPMNSATISTMTPGQITYTATSTKSNTKESRDS

SEQ ID NO: 55 - protein, 36 aa, Homo sapiens
DHYNCVSSGGQCLYSACPIFTKIQGTCYRGKAKCCK

SEQ ID NO: 56 - protein, 30 aa, Homo sapiens
DCYCRIPACIAGERRYGTCIYQGRLWAFCC

SEQ ID NO: 57 - protein, 80 aa, Homo sapiens
MKVFFLFAVLFCLVQTNSGDVPPGIRNTICRMQQGICRLFFCHSGEKKRDICSDPWNRCCVSNTDEEGKEKPEMDGRSGI

SEQ ID NO: 58 - protein, 33 aa, Homo sapiens
GYDTEVGEAGSQLSGGQRQAVALARALIRKPCV

SEQ ID NO: 59 - protein, 84 aa, Homo sapiens
MALSSQIWAACLLLLLLLASLTSGSVFPQQTGQLAELQPQDRAGARASWMPMFQRRRRRDTHFPICIFCCGCCHRSKCGMCCKT

SEQ ID NO: 60 - protein, 215 aa, Homo sapiens
MGKGDPKKPRGKMSSYAFFVQTCREEHKKKHPDASVNFSEFSKKCSERWKTMSAKEKGKFEDMAKADKARYEREMKTYIPPKGETKKKFKDPNAPKRPPSAFFLFCSEYRPKIKGEHPGLSIGDVAKKLGEMWNNTAADDKQPYEKKAAKLKEKYEKDIAAYRAKGKPDAAKKGVVKAEKSKKKKEEEEDEEDEEDEEEEEDEEDEDEEEDDDDE

SEQ ID NO: 61 - protein, 81 aa, Homo sapiens
MWHLKLCAVLMIFLLLLGQIDGSPIPEVSSAKRRPRRMTPFWRGVSLRPIGASCRDDSECITRLCRKGQQSPPTMLRSMEY

SEQ ID NO: 62 - protein, 77 aa, Homo sapiens
MWHLKLCAVLMIFLLLLGQIDGSPIPEVSSAKRRPRRMTPFWRGVSLRPIGASCRDDSECITRLCRKRRCSLSVAQE

SEQ ID NO: 63 - protein, 148 aa, Homo sapiens
MKALIVLGLVLLSVTVQGKVFERCELARTLKRLGMDGYRGISLANWMCLAKWESGYNTRATNYNAGDRSTDYGIFQINSRYWCNDGKTPGAVNACHLSCSALLQDNIADAVACAKRVVRDPQGIRAWVAWRNRCQNRDVRQYVQGCGV

SEQ ID NO: 64 - protein, 94 aa, Homo sapiens
MRTLAILAAILLVALQAQAEPLQARADEVAAAPEQIAADIPEVVVSLAWDESLAPKHPGSRKNMACYCRIPACIAGERRYGTCIYQGRLWAFCC

SEQ ID NO: 65 - protein, 94 aa, Homo sapiens
MRTLAILAAILLVALQAQAEPLQARADEVAAAPEQIAADIPEVVVSLAWDESLAPKHPGSRKNMDCYCRIPACIAGERRYGTCIYQGRLWAFCC

SEQ ID NO: 66 - protein, 97 aa, Homo sapiens
MRIIALLAAILLVALQVRAGPLQARGDEAPGQEQRGPEDQDISISFAWDKSSALQVSGSTRGMVCSCRLVFCRRTELRVGNCLIGGVSFTYCCTRVD

SEQ ID NO: 67 - protein, 56 aa, Homo sapiens
MPCFSWWPCRLRRSHFRQELMKLQPRSSLEQMIRKWLMPLHGMKVPLFRFQTQREA

SEQ ID NO: 68 - protein, 156 aa, Homo sapiens
MAPARAGFCPLLLLLLLGLWVAEIPVSAKPKGMTSSQWFKIQHMQPSPQACNSAMKNINKHTKRCKDLNTFLHEPFSSVAATCQTPKIACKNGDKNCHQSHGPVSLTMCKLTSGKYPNCRYKEKRQNKSYVVACKPPQKKDSQQFHLVPVHLDRVL

SEQ ID NO: 69 - protein, 46 aa, Homo sapiens [sequence omitted]

SEQ ID NO: 70 - protein, 677 aa, Homo sapiens
MQPTLLLSLLGAVGLAAVNSMPVDNRNHNEGMVTRCIIEVLSNALSKSSAPPITPECRQVLKTSRKDVKDKETTENENTKFEVRLLRDPADASEAHESSSRGEAGAPGEEDIQGPTKADTEKWAEGGGHSRERADEPQWSLYPSDSQVSEEVKTRHSEKSQREDEEEEEGENYQKGERGEDSSEEKHLEEPGETQNAFLNERKQASAIKKEELVARSETHAAGHSQEKTHSREKSSQESGEEAGSQENHPQESKGQPRSQEESEEGEEDATSEVDKRRTRPRHHHGRSRPDRSSQGGSLPSEEKGHPQEESEESNVSMASLGEKRDHHSTHYRASEEEPEYGEEIKGYPGVQAPEDLEWERYRGRGSEEYRAPRPQSEESWDEEDKRNYPSLELDKMAHGYGEESEEERGLEPGKGRHHRGRGGEPRAYFMSDTREEKRFLGEGHHRVQENQMDKARRHPQGAWKELDRNYLNYGEEGAPGKWQQQGDLQDTKENREEARFQDKQYSSHHTAEKRKRLGELFNPYYDPLQWKSSHFERRDNMNDNFLEGEEENELTLNEKNFFPEYNYDWWEKKPFSEDVNWGYEKRNLARVPKLDLKRQYDRVAQLDQLLHYRKKSAEFPDFYDSEEPVSTHQEAENEKDRADQTVLTEDEKKELENLAAMDLELQKIAEKFSQRG

SEQ ID NO: 71 - protein, 226 aa, Homo sapiens
AEGKWGLAHGRAEAHVWPGQGGWRLGPPQGRWTGSSPLLDIVGGRKARPRQFPFLASIQNQGRHFCGGALIHARFVMTAASCFQSQNPGVSTVVLGAYDLRRRERQSRQTFSISSMSENGYDPQQNLNDLMLLQLDREANLTSSVTILPLPLQNATVEAGTRCQVAGWGSQRSGGRLSRFPRFVNVTVTPEDQCRPNNVCTGVLTRRGGICNVSAPCGGRRGPERY

SEQ ID NO: 72 - protein, 84 aa, Carcinus maenas
NKDCKYWCKDNLGLNYCCGQPGVTYPPFTKKHLGRCPAVRDTCTGVRTQLPTYCPHDGACQFRSKCCYDTCLKHHVCKTAEYPY

SEQ ID NO: 73 - protein, 19 aa, Cyprinus carpio
GIGGKPVQTAFVDNDGIYD

SEQ ID NO: 74 - protein, 37 aa, Androctonus australis
GFGCPFNQGACHRHCRSIRRRGGYCAGLFKQTCTCYR

SEQ ID NO: 75 - protein, 38 aa, Leiurus quinquestriatus
GFGCPLNQGACHRHCRSIRRRGGYCAGFFKQTCTCYRN

SEQ ID NO: 76 - protein, 164 aa, Ovis aries
METQMASPSLGRCSLWLLLLGLLLPSASAQALSYREAVLRAVGQLNEKSSEVNLYRLLELDPPPKDAEDQGARKPVSFRVKETVCPRTSQQPPEQCDFKENGLVKQCVGTVSLDTSNDEFDLNCNELQSVRRLRPRRPRLPRPRPRPRPRPRSLPLPRPQPRRI

SEQ ID NO: 77 - protein, 39 aa, Bombus pascuorum
FVPYNPPRPGQSKPFPSFPGHGPFNPKIQWPYPLPNPGH

SEQ ID NO: 78 - protein, 53 aa, Apis mellifera
MKVVIFIFALLATICAAFAYVPLPNVPQPGRRPFPTFPGQGPFNPKIKWPQGY

SEQ ID NO: 79 - protein, 71 aa, Acalolepta luxuriosa
SLQPGAPNVNNKDQPWQVSPHISRDDSGNTRTDINVQRHGENNDFEAGWSKVVRGPNKAKPTWHIGGTHRW

SEQ ID NO: 80 - protein, 531 aa, Achatina fulica
MLLLNSALFILCLVCWLPGTSSSRVLTRREGPQCSRSVDVAVVGAGPSGTYSAYKLRNKGQTVELFEYSNRIGGRLFTTHLPNVPDLNLESGGMRYFKNHHKIFGVLVKELNLSNKEFTEGFGKPGRTRFFARGKSLTLEEMTSGDVPYNLSTEEKANQANLAGYYLKKLTGFDGEVLTIPQANKLEVDDGRKLYQLTVDEALDKVGTPEGKEFLKAFSTGNTEFIEGVSAVNYFLVELGEREEEILTLTDGMSALPQALADAFLKSSTSHALTLNRKLQSLSKTDNGLYLLEFLETNTHEGYTEESNITDLVCARKVILAIPQSALIHLDWKPLRSETVNEAFNAVKFIPTSKVFLTFPTAWWLSDAVKNPAFVVKSTSPFNQMYDWKSSNVTGDAAMIASYADTSDTKFQENLNSKGELIPGSAPGANRVTVALKEELLSQLSQAYGIERSDIPEPKSGTSQFWSSYPFEGDWTVWKAGYHCEYTQYIIERPSLIDDVFVVGSDHVNCIENAWTESAFLSVENVFEKYF

SEQ ID NO: 81 - protein, 87 aa, Sus scrofa
MSQAEFEKAAEEVKNLKTKPADDEMLFIYSHYKQATVGDINTERPGILDLKGKAKWDAWNGLKGTSKEDAMKAYINKVEELKKKYGI

SEQ ID NO: 82 - protein, 81 aa, Phyllomedusa bicolor
MAFLKKSLFLVLFLGLVSLSICEEEKRENEDEEEQEDDEQSEMKRGLWSKIKEVGKEAAKAAAKAAGKAALGAVSEAVGEQ

SEQ ID NO: 83 - protein, 96 aa, Macaca mulatta
MRTLAILAAILLVALQAQAEPLQARTDEATAAQEQIPTDNPEVVVSLAWDESLAPKDSVPGLRKNMACYCRIPACLAGERRYGTCFYMGRVWAFCC

SEQ ID NO: 84 - protein, 96 aa, Macaca mulatta
MRTLAILAAILLVALQAQAEPLQARTDEATAAQEQIPTDNPEVVVSLAWDESLAPKDSVPGLRKNMACYCRIPACLAGERRYGTCFYLGRVWAFCC

SEQ ID NO: 85 - protein, 94 aa, Macaca mulatta
MRTLAILAAILLFALLAQAKSLQETADDAATQEQPGEDDQDLAVSFEENGLSTLRASGSQARRTCRCRFGRCFRRESYSGSCNINGRIFSLCCR

SEQ ID NO: 86 - protein, 222 aa, Bos taurus
MKFFIFTCLLAVALAKNTMEHVSSSEESIISQETYKQEKNMAINPSKENLCSTFCKEVVRNANEEEYSIGSSSEESAEVATEEVKITVDDKHYQKALNEINQFYQKFPQYLQYLYQGPIVLNPWDQVKRNAVPITPTLNREQLSTSEENSKKTVDMESTEVFTKKTKLTEEEKNRLNFLKKISQRYQKFALPQYLKTVYQHQKAMKPWIQPKTKVIPYVRYL

SEQ ID NO: 87 - protein, 25 aa, Androctonus australis
RSVCRQIKICRRRGGCYYKCTNRPY

SEQ ID NO: 88 - protein, 57 aa, Drosophila mauritiana
MKYFVVLVVLALILAITVGPSDAVFIDILDKMENAIHKAAQAGIGIAKPIEKMILPK

SEQ ID NO: 89 - protein, 57 aa, Drosophila melanogaster
MKYFVVLVVLALILAISVGPSDAVFIDILDKVENAIHNAAQVGIGFAKPFEKLINPK

SEQ ID NO: 90 - protein, 67 aa, Drosophila orena
MKYFLVLVVLTLILAISVGQSDALFVDIIDNVENAIHKAAKTGIGMVKPIENIFIPNQQKKSTEASN

SEQ ID NO: 91 - protein, 57 aa, Drosophila sechellia
MKYFVVLVVLALILAITVDPSDAVFIDILDKMENAIHKAAQAGIGLAKPIENMILPK

SEQ ID NO: 92 - protein, 60 aa, Drosophila simulans
MKYFVVLVVLALILAIAVGPSDAVFIDILDKMENAIHKAAQAGIGIAKPIENMILPKLTK

SEQ ID NO: 93 - protein, 62 aa, Drosophila teissieri
MKYFSVLVVLTLILAIVDQSDAFINLLDKVEDALHTGAQAGFKLIRPVERGATPKKSEKPEK

SEQ ID NO: 94 - protein, 60 aa, Drosophila yakuba
MKYFSVLVVLTLILAISVGQSNAIFVDVLDNVETALHNAAKAGFKLIKPIEKMIMPSKEK

SEQ ID NO: 95 - protein, 144 aa, Bombina maxima
MNFKYIFAVSFLIASAYARSVQNDEQSLSQRDVLEEESLREIRGIGGKILSGLKTALKGAAKELASTYLHRKRTAEEHEEMKRLEAVMRDLDSLDYPEEASERETRGFNQDEIANLFTKKEKRILGPVLGLVSDTLDDVLGILG

SEQ ID NO: 96 - protein, 30 aa, Carcinus maenas
  misc_feature (1)..(2): Xaa can be any naturally occurring amino acid
XXVPYPRPFPRPPIGPRPLPFPGGGRPFQS

SEQ ID NO: 97 - protein, 158 aa, Bos taurus
METQRASLSLGRWSLWLLLLGLALPSASAQALSYREAVLRAVDQFNERSSEANLYRLLELDPPPKEDDENPNIPKPVSFRVKETVCPRTSQQPAEQCDFKENGLVKQCVGTVTLDAVKGKINVTCEELQSVGRFKRFRKKFKKLFKKLSPVIPLLHLG

SEQ ID NO: 98 - protein, 159 aa, Bos taurus
METQRASLSLGRWSLWLLLLGLALPSASAQALSYREAVLRAVDQLNEKSSEANLYRLLELDPPPKEDDENPNIPKPVSFRVKETVCPRTSQQSPEQCDFKENGLLKECVGTVTLDQVGSNFDITCAVPQSVGGLRSLGRKILRAWKKYGPIIVPIIRIG

SEQ ID NO: 99 - protein, 165 aa, Bos taurus
METQRASFSLGRSSLWLLLLGLVVPSASAQDLSYREAVLRAVDQFNERSSEANLYRLLELDPPPEQDVEHPGARKPVSFTVKETVCPRTTPQPPEQCDFKENGLVKQCVGTVTRYWIRGDFDITCNNIQSAGLFRRLRDSIRRGQQKILEKARRIGERIKDIFRG

SEQ ID NO: 100 - protein, 59 aa, Bombyx mori
MNFTRIIFFLFVVVFATASGKPWNIFKEIERAVARTRDAVISAGPAVRTVAAATSVASG

SEQ ID NO: 101 - protein, 153 aa, Sus scrofa
METQRASLCLGRWSLWLLLLGLVVPSASAQALSYREAVLRAVDRLNEQSSEANLYRLLELDQPPKADEDPGTPKPVSFTVKETVCPRPTRQPPELCDFKENGRVKQCVGTVTLKEIRGNFDITCNQLQSVRIIDLLWRVRRPQKPKFVTVWVR

SEQ ID NO: 102 - protein, 166 aa, Sus scrofa
METQRASLCLGRWSLWLLLLGLVVPSASAQALSYREAVLRAVDRLNEQSSEANLYRLLELDQPPKADEDPGTPKPVSFTVKETVCPRPTWRPPELCDFKENGRVKQCVGTVTLNPSNDPLDINCDEIQSVGRFRRLRKKTRKRLKKIGKVLKWIPPIVGSIPLGCG

SEQ ID NO: 103 - protein, 167 aa, Sus scrofa
METQRASLCLGRWSLWLLLLALVVPSASAQALSYREAVLRAVDRLNEQSSEANLYRLLELDQPPKADEDPGTPKPVSFTVKETVCPRPTWRPPELCDFKENGRVKQCVGTVTLDQIKDPLDITCNEIQSVGLLSRLRDFLSDRGRRLGEKIERIGQKIKDLSEFFQS

SEQ ID NO: 104 - protein, 88 aa, Carcinus maenas
GLFPNKDCKYWCKDNLGLNYCCGQPGVTYPPFTKKHLGRCPAVRDTCTGVRTQLPTYCPHDGACQFRSKCCYDTCLKHHVCKTAEYPY

SEQ ID NO: 105 - protein, 172 aa, Sus scrofa
METQRASLCLGRWSLWLLLLGLVVPSASAQALSYREAVLRAVDRLNEQSSEANLYRLLELDQPPKADEDPGTPKPVSFTVKETVCPRPTRQPPELCDFKENGRVKQCVGTVTLNPSIHSLDISCNEIQSVRRRPRPPYLPRPRPPPFFPPRLPPRIPPGFPPRFPPRFPGKR

SEQ ID NO: 106 - protein, 172 aa, Sus scrofa
METQRASLCLGRWSLWLLLLALVVPSASAQALSYREAVLRAVDRLNEQSSEANLYRLLELDQPPKADEDPGTPKPVSFTVKETVCPRPTRQPPELCDFKENGRVKQCVGTVTLNPSIHSLDISCNEIQSVRRRPRPPYLPRPRPPPFFPPRLPPRIPPGFPPRFPPRFPGKR

SEQ ID NO: 107 - protein, 42 aa, Cavia porcellus
  misc_feature (28)..(28): Xaa can be any naturally occurring amino acid
GLRKKFRKTRKRIQKLGRKIGKTGRKVXKAWREYGQIPYPCR

SEQ ID NO: 108 - protein, 76 aa, Galleria mellonella
MKIAFIVAISLAFLAVTSCIEFEKSTESHDIQKRGVTITVKPPFPGCVFYECIANCRSRGYKNGGYCTINGCQCLR

SEQ ID NO: 109 - protein, 85 aa, Sarcophaga peregrina
MVKLFVIVILALIAVAFGQHGHGGQDQHGYGHGQQAVYGKGHEGHGVNNLGQDGHGQHGYAHGHSDQHGHGGQHGQHDGYKNRGY

SEQ ID NO: 110 - protein, 66 aa, Xenopus laevis
LKCVNLQANGIKMTQECAKEDTKCLTLRSLKKTLKFCASGRTCTTMKIMSLPGEQITCCEGNMCNA

SEQ ID NO: 111 - protein, 34 aa, Acrocinus longimanus
CIKNGNGCQPDGSQGNCCSRYCHKEPGWVAGYCR

SEQ ID NO: 112 - protein, 34 aa, Acrocinus longimanus
CIANRNGCQPDGSQGNCCSGYCHKEPGWVAGYCR

SEQ ID NO: 113 - protein, 36 aa, Acrocinus longimanus
CIKNGNGCQPNGSQGNCCSGYCHKQPGWVAGYCRRK

SEQ ID NO: 114 - protein, 208 aa, Glossina morsitans
MQSFKICFFISCLSVVLVKGQFGGTVSSNPNGGLDVNARLSKTIGDPNANVVGGVFAAGNTDGGPATRGAFLAANKDGHGLSLQHSKTDNFGSSLTSSAHAHLFNDKTHKLDANAFHSRTHLDNGFKFDRVGGGLRYDHVTGHGASLTASRIPQLDMNTLGLTGKANLWSSPNRATTLDLTGGVSKHFGGPFDGQTNKQIGLGLNSRF

SEQ ID NO: 115 - protein, 67 aa, Manduca sexta
MKFSRVLFFVFACFAAFTVTAAKPWDFLKELEGAGQRIRDAIISAQPAVETIAQATAIFKGQSKEED

SEQ ID NO: 116 - protein, 39 aa, Gallus gallus
GRKSDCFRKSGFCAFLKCPSLTLISGKCSRFYLCCKRIR

SEQ ID NO: 117 - protein, 34 aa, Gallus gallus
  misc_feature (30)..(30): Xaa can be any naturally occurring amino acid
GRKSDCFRKNGFCAFLKCPYLTLISGLCSXFHLC

SEQ ID NO: 118 - protein, 87 aa, Glossina morsitans
MKFYLVLAFLTLCAVAVTALPAGDETRIDLETLEEDLRLVDGAQVTGELKRDKRVTCNIGEWVCVAHCNSKSKKSGYCSRGVCYCTN

SEQ ID NO: 119 - protein, 76 aa, Glossina morsitans
PQSPPAQIKDPKIYASGGGSPKDGYNVNVDVRKNVWVSQNGRHSIDATGGYSQHLGGPYGNSRPDFRGGASYTYRF

SEQ ID NO: 120 - protein, 46 aa, Equus caballus
  misc_feature (13)..(13): Xaa can be any naturally occurring amino acid
  misc_feature (24)..(24): Xaa can be any naturally occurring amino acid
DVQCGEGHFCHDXQTCCRASQGGXACCPYSQGVCCADQRHCCPVGF

SEQ ID NO: 121 - protein, 46 aa, Equus caballus
EVERKHPLGGSRPGRCPTVPPGTFGHCACLCTGDASEPKGQKCCSN

SEQ ID NO: 122 - protein, 171 aa, Manduca sexta
AILFAAIVACACAQVSMPPQYAQIYPEYYKYSKQVRHPRDVTWDKQVGNNGKVFGTLGQNDQGLFGKGGYQHQFFDDHRGKLTGQGYGSRVLGPYGDSTNFGGRLDWANKNANAALDVTKSIGGRTGLTASGSGVWQLGKNTDLSAGGTLSQTLGHGKPDVGFQGLFQHRW

SEQ ID NO: 123 - protein, 82 aa, Sus scrofa
MALSVQIRAACLLLLLLVSLTAGSVLPSQTRQLTDLRTQDTAGATAGLTPVAQRLRRDTHFPICIFCCGCCRKAICGMCCKT

SEQ ID NO: 124 - protein, 76 aa, Lumbricus rubellus
MSLCISDYLYLTLTFSKYERQKDKRPYSERKNQYTGPQFLYPPERIPPQKVIKWNEEGLPIYEIPGEGGHAEPAAA

SEQ ID NO: 125 - protein, 82 aa, Mytilus galloprovincialis
MKAVFVLLVVGLCIMMMDVATAGFGCPNNYACHQHCKSIRGYCGGYCASWFRLRCTCYRCGGRRDDVEDIFDIYDNVAVERF

SEQ ID NO: 126 - protein, 67 aa, Manduca sexta
MKLTSLFIFVIVALSLLFSSTDAAPGKIPVKAIKQAGKVIGKGLRAINIAGTTHDVVSFFRPKKKKH

SEQ ID NO: 127 - protein, 160 aa, Equus caballus
MKKMGCGGRLSSCPTMTSRALLLLASALLGTPGLTFSGLNPESYDLATAHLSDGEQFCQGLTQEDLQGDLLTERERQGIACWSCRKILQKLEDLVGEQPNEATINEAASRVCRNLGLLRGACKKIMRTCLRLISRDILAGKKPQEVCVDIKLCKHKAGLI

SEQ ID NO: 128 - protein, 24 aa, Xenopus laevis
GVLSNVIGYLKKLGTGALNAVLKQ

SEQ ID NO: 129 - protein, 65 aa, Meleagris gallopavo
MRIVYLLFPFILLLAQGAAGSSLALGKREKCLRRNGFCAFLKCPTLSVISGTCSRFQVCCKTLLG

SEQ ID NO: 130 - protein, 64 aa, Meleagris gallopavo
MRILYLLFSLLFLALQVSPGLSSPKRDMLFCKRGTCHFGRCPSHLIKVGSCFGFRSCCKWPWDA

SEQ ID NO: 131 - protein, 25 aa, Meleagris gallopavo
LSCKRGTCHFGRCPSHLIKGSCSGG

SEQ ID NO: 132 - protein, 207 aa, Manduca sexta
KMFTKFVVLVCLLVGAKARPQLGALTFNSDGTSGAAVKVPFGGNKNNIFSAIGGADFNANHKLSSATAGVALDNIRGHGLSLTDTHIPGFGDKLTAAGKLNLFHNNNHDLTANAFATRNMPNIPQVPNFNTVGGGLDYMFKNKVGASLGAAHTDFINRNDYSVGGKLNLFRNPSTSLDFNAGFKKFDTPFMRSGWEPNMGFSLSKFF

SEQ ID NO: 133 - protein, 171 aa, Oryctolagus cuniculus
METHKHGPSLAWWSLLLLLLGLLMPPAIAQDLTYREAVLRAVDAFNQQSSEANLYRLLSMDPQQLEDAKPYTPQPVSFTVKETECPRTTWKLPEQCDFKEDGLVKRCVGTVTRYQAWDSFDIRCNRAQESPEPTGLRKRLRKFRNKIKEKLKKIGQKIQGFVPKLAPRTDY

SEQ ID NO: 134 - protein, 67 aa, Pheretima tschiliensis
MYSKYERQKDKRPYSERKDQYTGPQFLYPPDRIPPSKAIKWNEEGLPMYEVLPDGAGAKTAVEAAAE

SEQ ID NO: 135 - protein, 17 aa, Bombus pascuorum
GNRPVYIPPPRPPHPRL

SEQ ID NO: 136 - protein, 26 aa, Apis mellifera
EAKPEAKPGNNRPVYIPQPRPPHPRL

SEQ ID NO: 137 - protein, 168 aa, Apis mellifera
MKNFALAILVVTFVVAVFGNTNLDPPTRPARLRREAKPEAEPGNNRPIYIPQPRPPHPRLRREAEPKAEPGNNRPIYIPQPRPPHPRLRREAESEAEPGNNRPVYIPQPRPPHPRLRREPEAEPGNNRPVYIPQPRPPHPRLRREPEAEPGNNRPVYIPQPRPPHPRI

SEQ ID NO: 138 - protein, 144 aa, Apis mellifera
MKNFALAILVVTFVVAVFGNTNLDPPTRPTRLRREAEPEAEPGNNRPVYIPQPRPPHPRLRREAEPEAEPGNNRPVYIPQPRPPHPRLRREAEPEAEPGNNRPVYIPQPRPPHPRLRREAEPEAEPGNNRPVYIPQPRPPHPRI

SEQ ID NO: 139 - protein, 283 aa, Apis mellifera
KNFALAILVVTFVVAVFGNTNLDPPTRPTRLRREAKPEAEPGNNRPVYIPQPRPPHPRLRREAEPEAEPGNNRPVYIPQPRPPHPRLRREAELEAEPGNNRPVYISQPRPPHPRLRREAEPEAEPGNNRPVYIPQPRPPHPRLRREAELEAEPGNNRPVYISQPRPPHPRLRREAEPEAEPGNNRPVYIPQPRPPHPRLRREAEPEAEPGNNRPVYIPQPRPPHPRLRREAEPEAEPGNNRPVYIPQPRPPHPRLRREAKPEAKPGNNRPVYIPQPRPPHPRI

SEQ ID NO: 140 - protein, 76 aa, Bos taurus
QAEESNLQSLVSQYFQTVADYGKDLVEKAKGSELQTQAKAYFEKTQEELTPFFKKAGTDLLNFLSSFIDPKKQPAT

SEQ ID NO: 141 - protein, 93 aa, Ascaris suum
MKTAIIVVLLVIFASTNAAVDFSSCARMDVPGLSKVAQGLCISSCKFQNCGTGHCEKRGGRPTCVCDRCGRGGGEWPSVPMPKGRSSRGRRHS

SEQ ID NO: 142 - protein, 65 aa, Ascaris suum
MVTKGIVLFMLVILFASTDAATCGYDDAKLNRPTIGCILSCKVQGCETGACYLRDSRPICVCKRC

SEQ ID NO: 143 - protein, 94 aa, Ascaris suum
MKAILIALLLTTFTVVNGGVVLTSCARMDTPVLSKAAQGLCITSCKYQNCGTGFCQKVGGRPTCMCRRCANGGGSWPVIPLDTLVKLALKRGKR

SEQ ID NO: 144 - protein, 35 aa, Ascaris suum
TSCKYQNCGTGFCQKVGGRPTCMCRRCANGGGSWP

SEQ ID NO: 145 - protein, 224 aa, Drosophila melanogaster
MQKTSILIVALVALFAITEALPSLPTTGPIRVRRQVLGGSLTSNPAGGADARLDLTKGIGNPNHNVVGQVFAAGNTQSGPVTTGGTLAYNNAGHGASLTKTHTPGVKDVFQQEAHANLFNNGRHNLDAKVFASQNKLANGFEFQRNGAGLDYSHINGHGASLTHSNFPGIGQQLGLDGRANLWSSPNRATTLDLTGSASKWTSGPFANQKPNFGAGLGLSHHFG

SEQ ID NO: 146 - protein, 254 aa, Trichoplusia ni
MFTYKLILGLVLVVSASARYLVFEDLEGESYLVPNQAEDEQVLEGEPFYENAVQLASPRVRRQAQGSVTLNSDGSMGLGAKVPIVGNEKNVLSALGSVDLNDQLKPASRGMGLALDNVNGHGLSVMKETVPGFGDRLTGAGRVNVFHNDNHDISAKAFVTKNMPDFPNVPNFNTVGGGVDYMYKNKVGASLGMANTPFLDRKDYSAMGNLNVFRSPTTSVDFNAGFKKFDTPVFKSNWEPNFGLTFSRSFGNKW

SEQ ID NO: 147 - protein, 218 aa, Drosophila melanogaster
MQKTSILILALFAIAEAVPTTGPIRVRRQVLGGSLASNPAGGADARLNLSKGIGNPNHNVVGQVFAAGNTQSGPVTTGGTLAYNNAGHGASLTKTHTPGVKDVFQQEAHANLFNNGRHNLDAKVFASQNKLANGFEFQRNGAGLDYSHINGHGASLTHSNFPGIGQQLGLDGRANLWSSPNRATTLDLTGSASKWTSGPFANQKPNFGAGLGLSHHFG

SEQ ID NO: 148 - protein, 233 aa, Hyalophora cecropia
MFAKLFLVSVLLVGVNSRYVLVEEPGYYDKQYEEQPQQWVNSRVRRQAGALTINSDGTSGAVVKVPITGNENHKFSALGSVDLTNQMKLGAATAGLAYDNVNGHGATLTKTHIPGFGDKMTAAGKVNLFHNDNHDFSAKAFATKNMPNIPQVPNFNTVGAGVDYMFKDKIGASANAAHTDFINRNDYSLGGKLNLFKTPTTSLDFNAGWKKFDTPFFKSSWEPSTSFSFSKYF

SEQ ID NO: 149 - protein, 235 aa, Hyalophora cecropia
MFGKIVFLLLVALCAGVQSRYLIVSEPVYYIEHYEEPELLASSRVRRDAHGALTLNSDGTSGAVVKVPFAGNDKNIVSAIGSVDLTDRQKLGAATAGVALDNINGHGLSLTDTHIPGFGDKMTAAGKVNVFHNDNHDITAKAFATRNMPDIANVPNFNTVGGGIDYMFKDKIGASASAAHTDFINRNDYSLDGKLNLFKTPDTSIDFNAGFKKFDTPFMKSSWEPNFGFSLSKYF

SEQ ID NO: 150 - protein, 214 aa, Bombyx mori
MSKSVALLLLCACLASGRHVPTRARRQAGSFTVNSDGTSGAALKVPLTGNDKNVLSAIGSADFNDRHKLSAASAGLALDNVNGHGLSLTGTRIPGFGEQLGVAGKVNLFHNNNHDLSAKAFAIRNSPSAIPNAPNFNTLGGGVDYMFKQKVGASLSAAHSDVINRNDYSAGGKLNLFRSPSSSLDFNAGFKKFDTPFYRSSWEPNVGFSFSKFF

SEQ ID NO: 151 - protein, 221 aa, Drosophila melanogaster
MQNTSILIVALVALFAITEALPTTGPIRVRRQVLGGSLTSNPAGGADARLDLTKGIGNPNHNVVGQVFAAGNTQSGPVTTGGTLAYNNAGHGASLTKTHTPGVKDVFQQEAHANLFNNGRHNLDAKVFASQNKLANGFEFQRNGAGLDYSHINGHGASLTHSNFPGIGQQLGLDGRANLWSSPNRATTLDLTGSASKWTSGPFANQKPNFGAGLGLSHHFG

SEQ ID NO: 152 - protein, 218 aa, Drosophila melanogaster
MQKTSILILALFAIAEAVPTTGPIRVRRQVLGGSLASNPAGGADARLNLSKGIGNPNHNVVGQVFAAGNTQSGPVTTGGTLAYNNAGHGASLTKTHTPGVKDVFQQEAHANLFNNGRHNLDAKVFASQNKLANGFEFQRNGAGLDYSHINGHGGSLTHSNFPGIGQQLGLDGRANLWSSPNRATTLDLTGSASKWTSGPFANQKPNFGAGLGLSHHFG

SEQ ID NO: 153 - protein, 219 aa, Sus scrofa
IVGGRRAQPQEFPFLASIQKQGRPFCAGALVHPRFVLTAASCFRGKNSGSASVVLGAYDLRQQEQSRQTFSIRSISQNGYDPRQNLNDVLLLQLDREARLTPSVALVPLPPQNATVEAGTNCQVAGWGTQRLRRLFSRFPRVLNVTVTSNPCLPRDMCIGVFSRRGRISQGDRGTPLVCNGLAQGVASFLRRRFRRSSGFFTRVALFRNWIDSVLNNPP

SEQ ID NO: 154 - protein, 42 aa, Bos taurus
RFRPPIRRPPIRPPFYPPFRPPIRPPIFPPIRPPFRPPLRFP

SEQ ID NO: 155 - protein, 176 aa, Ovis aries
METQGASLSLGRWSLWLLLLGLVLPSASAQALSYREAVLRAVGQLNERSSEANLYRLLELDPAPNDEVDPGTRKPVSFTVKETVCPRTTQQPPEECDFKENGLVKQCVGTVTLDPSNDQFDINCNELQSVRFRPPIRRPPIRPPFRPPFRPPVRPPIRPPFRPPFRPPIGPFPGRR

SEQ ID NO: 156 - protein, 176 aa, Bos taurus
METQRASLSLGRCSLWLLLLGLVLPSASAQALSYREAVLRAVDQFNERSSEANLYRLLELDPTPNDDLDPGTRKPVSFRVKETDCPRTSQQPLEQCDFKENGLVKQCVGTVTLDPSNDQFDINCNELQSVRFRPPIRRPPIRPPFYPPFRPPIRPPIFPPIRPPFRPPLGPFPGRR

SEQ ID NO: 157 - protein, 176 aa, Capra hircus
METQGASLSLGRWSLWLLLLGLVVPLASAQALSYREAVLRAVGQLNERSSEANLYRLLELDPAPNDEVDPGTRKPVSFTVKETVCPRTTQQPPEECDFKENGLVKQCVGTVTLDPSNDQFDINCNELQSVRFRPPIRRPPIRPPFNPPFRPPVRPPFRPPFRPPFRPPIGPFPGRR

SEQ ID NO: 158 - protein, 59 aa, Bos taurus
RRIRPRPPRLPRPRPRPLPFPRPGPRPIPRPLPFPRPGPRPIPRPLPFPRPGPRPIPRP

SEQ ID NO: 159 - protein, 190 aa, Ovis aries
METQMASPSLGRCSLWLLLLGLLLPSASAQALSYREAVLRAVGQLNEKSSEVNLYRLLELDPPPKDAEDQGARKPVSFRVKETVCPRMSQQPPEQCDFKENGLVKQCVGTVSLDTSNDEFDLNCNELQSVRRLRPRRPRLPRPRPRPRPRPRSLPLPRPQPRRIPRPILLPWRPPRPIPRPQPQPIPRWL

SEQ ID NO: 160 - protein, 190 aa, Bos taurus
METQRASLSLGRWSLWLLLLGLVLPSASAQALSYREAVLRAVDRINERSSEANLYRLLELDPPPKDVEDRGARKPTSFTVKETVCPRTSPQPPEQCDFKENGLVKQCVGTITLDQSDDLFDLNCNELQSVRRIRPRPPRLPRPRPRPLPFPRPGPRPIPRPLPFPRPGPRPIPRPLPFPRPGPRPIPRPL

SEQ ID NO: 161 - protein, 74 aa, Mus musculus
MKISYFLLLILSLGSSQINPVSGDDSIQCFQKNNTCHTNQCPYFQDEIGTCYDRRGKCCQKRLLHIRVPRKKKV

SEQ ID NO: 162 - protein, 78 aa, Mus musculus
MPVTKSYFMTVVVVLILVDETTGGLFGFRSSKRQEPWIACELYQGLCRNACQKYEIQYLSCPKTRKCCLKYPRKITSF

SEQ ID NO: 163 - protein, 64 aa, Capra hircus
MRLHHLLLALFFLVLSAGSGFTQGIINHRSCYRNKGVCAPARCPRNMRQIGTCHGPPVKCCRKK

SEQ ID NO: 164 - protein, 38 aa, Bos taurus
DFASCHTNGGICLPNRCPGHMIQIGICFRPRVKCCRSW

SEQ ID NO: 165 - protein, 64 aa, Capra hircus
MRLHHLLLVLFFLVLSAGSGFTQGIRSRRSCHRNKGVCALTRCPRNMRQIGTCFGPPVKCCRKK

SEQ ID NO: 166 - protein, 64 aa, Sus scrofa
MRLHRLLLVFLLMVLLPVPGLLKNIGNSVSCLRNKGVCMPGKCAPKMKQIGTCGMPQVKCCKRK

SEQ ID NO: 167 - protein, 68 aa, Pan troglodytes
MRTSYLLLFTLCLLLSEMASGGNFLTGLGHRSDHYNCVSSGGQCLYSACPIFTKIQGTCYRGKAKCCK

SEQ ID NO: 168 - protein, 69 aa, Mus musculus
MKTHYFLLVMICFLFSQMEPGVGILTSLGRRTDQYKCLQHGGFCLRSSCPSNTKLQGTCKPDKPNCCKS

SEQ ID NO: 169 - protein, 69 aa, Rattus norvegicus
MKTHYFLLVMLFFLFSQMELGAGILTSLGRRTDQYRCLQNGGFCLRSSCPSHTKLQGTCKPDKPNCCRS

SEQ ID NO: 170 - protein, 68 aa, Macaca mulatta
MRTSYLLLFTLCLLLSEMASGDNFLTGLGHRSDHYNCVRSGGQCLYSACPIYTRIQGTCYHGKAKCCK

SEQ ID NO: 171 - protein, 64 aa, Ovis aries
MRLHHLLLVLFFVVLSAGSGFTQGVRNRLSCHRNKGVCVPSRCPRHMRQIGTCRGPPVKCCRKK

SEQ ID NO: 172 - protein, 40 aa, Bos taurus
QGVRSYLSCWGNRGICLLNRCPGRMRQIGTCLAPRVKCCR

SEQ ID NO: 173 - protein, 38 aa, Bos taurus
GPLSCRRNGGVCIPIRCPGPMRQIGTCFGRPVKCCRSW

SEQ ID NO: 174 - protein, 123 aa, Macaca mulatta
MKLLLLALPILVLLPQVIPAYGGEKKCWNRSGHCRKQCKDGEAVKETCKNHRACCVPSNEDHRRLPTTSPTPLSDSTPGIIDNILTIRFTTDYFEISSKKDMVEESEAGQGTQTSPPNVHHTS

SEQ ID NO: 175 - protein, 38 aa, Bos taurus
GPLSCGRNGGVCIPIRCPVPMRQIGTCFGRPVKCCRSW

SEQ ID NO: 176 - protein, 123 aa, Macaca fascicularis
MKSLLFTLAVFMLLAQLVSGNLYVKRCLNDIGICKKTCKPEEVRSEHGWVMCGKRKACCVPADKRSAYPSFCVHSKTTKTSTVTARATATTATTATAATPLMISNGLISLMTTMAATPVSPTT

SEQ ID NO: 177 - protein, 42 aa, Bos taurus
SGISGPLSCGRNGGVCIPIRCPVPMRQIGTCFGRPVKCCRSW

SEQ ID NO: 178 - protein, 64 aa, Macaca mulatta
MRVLYLLFSFLFIFLMPLPGVFGGIGDPVTCLKNGAICHPVFCPRRYKQIGTCGLPGTKCCKKP

SEQ ID NO: 179 - protein, 40 aa, Bos taurus
VRNHVTCRINRGFCVPIRCPGRTRQIGTCFGPRIKCCRSW

SEQ ID NO: 180 - protein, 71 aa, Mus musculus
MRTLCSLLLICCLLFSYTTPAVGSLKSIGYEAELDHCHTNGGYCVRAICPPSARRPGSCFPEKNPCCKYMK

SEQ ID NO: 181 - protein, 63 aa, Rattus norvegicus
MRIHYLLFSFLLVLLSPLSAFTQSINNPITCLTKGGVCWGPCTGGFRQIGTCGLPRVRCCKKK

SEQ ID NO: 182 - protein, 64 aa, Ovis aries
MRLHHLLLVLFFVVLSAGSGFTHGVTDSLSCRWKKGICVLTRCPGTMRQIGTCFGPPVKCCRLK

SEQ ID NO: 183 - protein, 63 aa, Mus musculus
MRIHYLLFAFLLVLLSPPAAFSKKINNPVSCLRKGGRCWNRCIGNTRQIGSCGVPFLKCCKRK

SEQ ID NO: 184 - protein, 57 aa, Bos taurus
LALLFLVLSAGSGFTQGVRNHVTCRINRGFCVPIRCPGRTRQIGTCFGPRIKCCRSW

SEQ ID NO: 185 - protein, 63 aa, Mus musculus
MRIHYLLFTFLLVLLSPLAAFTQIINNPITCMTNGAICWGPCPTAFRQIGNCGHFKVRCCKIR

SEQ ID NO: 186 - protein, 63 aa, Bos taurus
MRLHHLLLAVLFLVLSAGSGFTQRVRNPQSCRWNMGVCIPFLCRVGMRQIGTCFGPRVPCCRR

SEQ ID NO: 187 - protein, 63 aa, Mus musculus
MRIHYLLFTFLPVLLSPLAAFTQIINNPITCMTNGAICWGPCPTAFRQIGNCGHFKVRCCKIR

SEQ ID NO: 188 - protein, 64 aa, Bos taurus
MRLHHLLLVLLFLVLSAGSGFTQVVRNPQSCRWNMGVCIPISCPGNMRQIGTCFGPRVPCCRRW

SEQ ID NO: 189 - protein, 63 aa, Mus musculus
MKIHYLLFAFILVMLSPLAAFSQLINSPVTCMSYGGSCQRSCNGGFRLGGHCGHPKIRCCRRK

SEQ ID NO: 190 - protein, 42 aa, Bos taurus
QGVRNHVTCRIYGGFCVPIRCPGRTRQIGTCFGRPVKCCRRW

SEQ ID NO: 191 - protein, 37 aa, Mus musculus
NSKRACYREGGECLQRCIGLFHKIGTCNFRFKCCKFQ

SEQ ID NO: 192 - protein, 40 aa, Bos taurus
QGVRNFVTCRINRGFCVPIRCPGHRRQIGTCLGPRIKCCR

SEQ ID NO: 193 - protein, 71 aa, Mus musculus
MRIHYVLFAFLLVLLSPFAAFSQDINSKRACYREGGECLQRCIGLFHKIGTCNFRFKCCKFQIPEKKTKIL

SEQ ID NO: 194 - protein, 35 aa, Mus musculus
NEPVSCIRNGGICQYRCIGLRHKIGTCGSPFKCCK

SEQ ID NO: 195 - protein, 60 aa, Mus musculus
MRIHYLLFTFLLVLLSPLAAFSQKINEPVSCIRNGGICQYRCIGLRHKIGTCGSPFKCCK

SEQ ID NO: 196 - protein, 38 aa, Bos taurus
VRNFVTCRINRGFCVPIRCPGHRRQIGTCLGPQIKCCR

SEQ ID NO: 197 - protein, 55 aa, Bos taurus
LALLFLVLSAGSGFTQGVRNFVTCRINRGFCVPIRCPGHRRQIGTCLAPQIKCCR

SEQ ID NO: 198 - protein, 53 aa, Bos taurus
LALLFLVLSAGSGISGPLSCRRKGGICILIRCPGPMRQIGTCFGRPVKCCRSW

SEQ ID NO: 199 - protein, 80 aa, Gallus gallus
MRIVYLLIPFFLLFLQGAAGTATQCRIRGGFCRVGSCRFPHIAIGKCATFISCCGRAYEVDALNSVRTSPWLLAPGNNPH

SEQ ID NO: 200 - protein, 59 aa, Meleagris gallopavo
MRIVYLLFPFFLLFLQSAAGTPIQCRIRGGFCRFGSCRFPHIAIAKCATFIPCCGSIWG

SEQ ID NO: 201 - protein, 64 aa, Equus caballus
MRILHFLLAFLIVFLLPVPGFTAGIETSFSCSQNGGFCISPKCLPGSKQIGTCILPGSKCCRKK

SEQ ID NO: 202 - protein, 85 aa, Mus musculus
MKNLPSNMALSREVFYFGFALFFIVVELPSGSWAGLEYSQSFPGGEIAVCETCRLGRGKCRRTCIESEKIAGWCKLNFFCCRERI

SEQ ID NO: 203 - protein, 64 aa, Pan troglodytes
MRVLYLLFSFLFIFLMPLPGVFGGISDPVTCLKSGAICHPVFCPRRYKQIGTCGLPGTKCCKKP

SEQ ID NO: 204 - protein, 42 aa, Bos taurus
QGVRNHVTCRINRGFCVPIRCPGRTRQIGTCFGPRIKCCRSW

SEQ ID NO: 205 - protein, 64 aa, Pan troglodytes
MRIHYLLFALLFLFLVPVPGHGGIINTLQKYYCRVRGGRCAVLTCLPKEEQIGKCSTRGRKCCR

SEQ ID NO: 206 - protein, 41 aa, Bos taurus
QRVRNPQSCRWNMGVCIPFLCRVGMRQIGTCFGPRVPCCRR

SEQ ID NO: 207 - protein, 40 aa, Bos taurus
QVVRNPQSCRWNMGVCIPISCPGNMRQIGTCFGPRVPCCR

SEQ ID NO: 208 - protein, 40 aa, Bos taurus
QGVRNFVTCRINRGFCVPIRCPGHRRQIGTCLGPQIKCCR

SEQ ID NO: 209 - protein, 65 aa, Canis familiaris
MKAFLLTLAALVLLSQVTSGSAEKCWNLRGSCREKCIKNEKLYIFCTSGKLCCLKPKFQPNMLQR

SEQ ID NO: 210 - protein, 69 aa, Canis familiaris
MKAFLLTLAALVLLSQVTSGSAEECWNLRGSCREKCIKNEKLYIFCTSGKLCCLKPKFQPNMLQRSVQF

SEQ ID NO: 211 - protein, 99 aa, Canis familiaris
MKAFLLTLAALVLLSQVTSGSAEKCWNLRGSCREKCIKNEKLYIFCTSGKLCCLKPKFQPNMLQRNRKDNPKICLELQKILNIQSNLDKEEQSWKHCTS

SEQ ID NO: 212 - protein, 79 aa, Tachypleus tridentatus
NPLIPAIYIGATVGPSVWAYLVALVGAAAVTAANIRRASSDNHSCAGNRGWCRSKCFRHEYVDTYYSAVCGRYFCCRSR

SEQ ID NO: 213 - protein, 20 aa, Bombina variegata
IIGPVLGMVGSALGGLLKKI

SEQ ID NO: 214 - protein, 21 aa, Bombina variegata
IIGPVLGMVGSALGGLLKKIG

SEQ ID NO: 215 - protein, 21 aa, Bombina variegata
LIGPVLGLVGSALGGLLKKIG

SEQ ID NO: 216 - protein, 21 aa, Bombina variegata
IIGPVLGLVGSALGGLLKKIG

SEQ ID NO: 217 - protein, 27 aa, Bombina orientalis
GIGSAILSAGKSALKGLAKGLAEHFAN

SEQ ID NO: 218 - protein, 25 aa, Bombina orientalis
GIGAAILSAGKSIIKGLANGLAEHF

SEQ ID NO: 219 - protein, 144 aa, Bombina orientalis
MNFKYIVAVSFLIASTYARSVKNDEQSLSQRDVLEEESLREIRGIGGALLSAGKSALKGLAKGLAEHFANGKRTAEEHEVMKRLEAVMRDLDSLDYPEEASEMETRSFNQEEIANLFTKKEKRILGPVLDLVGRALRGLLKKIG

SEQ ID NO: 220 - protein, 204 aa, Bombina orientalis
MNFKYIVAVSILIASAYARSEENDIQSLSQRDVLEEESLREIRGIGASILSAGKSALKGLAKGLAEHFANGKRTAEDHEVMKRLEAAIQSLSQRDVLEEESLREIRGIGASILSAGKSALKGLAKGLAEHFANGKRTAEEHEVMKRLEAVMRDLDSLDYPEEASEMETRSFNQEEIANLYTKKEKRILGPILGLVSNALGGLLG

SEQ ID NO: 221 - protein, 137 aa, Bombina variegata
MNFKYIVAVSILIASAYARSEENDIQSLSQRDVLEEESLREIRGIGGALLSAAKVGLKGLAKGLAEHFANGKRTAEEREVMKRLEAAMRDLDSFEHPEEASEKETRGFNQEEKEKRIIGPVLGLVGSALGGLLKKIG

SEQ ID NO: 222 - protein, 137 aa, Bombina variegata
MNFKYIVAVSILIASAYARREENNIQSLSQRDVLEEESLREIRGIGASILSAGKSALKGFAKGLAEHFANGKRTAEDHEMMKRLEAAVRDLDSLEHPEEASEKETRGFNQEEKEKRIIGPVLGLVGSALGGLLKKIG

SEQ ID NO: 223 - protein, 200 aa, Bombina orientalis
MNFKYIVAVSILIASAYARSEENDIQSLSQRDVLEEESLREIRGIGAAILSAGKSALKGLAKGLAEHFGKRTAEDHEVMKRLEAAIHSLSQRDVLEEESLREIRGIGAAILSAGKSALKGLAKGLAEHFGKRTAEEHEMMKRLEAVMRDLDSLDYPEEASEMETRSFNQEEIANLYTKKEKRILGPILGLVSNALGGLLG

SEQ ID NO: 224 - protein, 38 aa, Bos taurus
APLSCGRNGGVCIPIRCPVPMRQIGTCFGRPVKCCRSW

SEQ ID NO: 225 - protein, 24 aa, Rana brevipoda
FLPVLAGIAAKVVPALFCKITKKC

SEQ ID NO: 226 - protein, 24 aa, Rana berlandieri
FLPFIAGMAAKFLPKIFCAISKKC

SEQ ID NO: 227 - protein, 24 aa, Rana berlandieri
FLPAIAGMAAKFLPKIFCAISKKC

SEQ ID NO: 228 - protein, 24 aa, Rana berlandieri
FLPFIAGVAAKFLPKIFCAISKKC

SEQ ID NO: 229 - protein, 24 aa, Rana berlandieri
FLPAIAGVAAKFLPKIFCAISKKC

SEQ ID NO: 230 - protein, 24 aa, Rana berlandieri
FLPAIVGAAAKFLPKIFCVISKKC

SEQ ID NO: 231 - protein, 24 aa, Rana berlandieri
FLPFIAGMAANFLPKIFCAISKKC

SEQ ID NO: 232 - protein, 71 aa, Rana esculenta
MFTLKKSMLLLFFLGTINLSLCEEERDADEEERRDNPDESEVEVEKRFLPLLAGLAANFLPKIFCKITRKC

SEQ ID NO: 233 - protein, 24 aa, Rana esculenta
FLPAIFRMAAKVVPTIICSITKKC

SEQ ID NO: 234 - protein, 24 aa, Rana esculenta
VIPFVASVAAEMMQHVYCAASRKC

SEQ ID NO: 235 - protein, 23 aa, Rana esculenta
VIPFVASVAAEMQHVYCAASRKC

SEQ ID NO: 236 - protein, 24 aa, Rana luteiventris
FLPMLAGLAASMVPKLVCLITKKC

SEQ ID NO: 237 - protein, 24 aa, Rana luteiventris
FLPMLAGLAASMVPKFVCLITKKC

SEQ ID NO: 238 - protein, 24 aa, Rana pipiens
FLPIIAGVAAKVFPKIFCAISKKC

SEQ ID NO: 239 - protein, 24 aa, Rana pipiens
FLPIIAGIAAKVFPKIFCAISKKC

SEQ ID NO: 240 - protein, 24 aa, Rana pipiens
FLPIIASVAAKVFSKIFCAISKKC

SEQ ID NO: 241 - protein, 24 aa, Rana pipiens
FLPIIASVAANVFSKIFCAISKKC

SEQ ID NO: 242 - protein, 24 aa, Rana pipiens
FLPIIASVAAKVFPKIFCAISKKC

SEQ ID NO: 243 - protein, 24 aa, Rana sp.
FLPAIVGAAGQFLPKIFCAISKKC

SEQ ID NO: 244 - protein, 24 aa, Rana sp.
FLPAIVGAAGKFLPKIFCAISKKC

SEQ ID NO: 245 - protein, 24 aa, Rana sp.
FFPIVAGVAGQVLKKIYCTISKKC

SEQ ID NO: 246 - protein, 24 aa, Rana sylvatica
FLPVVAGLAAKVLPSIICAVTKKC

SEQ ID NO: 247 - protein, 20 aa, Rana temporaria
VNPIILGVLPKFVCLITKKC

SEQ ID NO: 248 - protein, 17 aa, Rana temporaria
FITLLLRKFICSITKKC

SEQ ID NO: 249 - protein, 33 aa, Rana brevipoda
GLLDSLKGFAATAGKGVLQSLLSTASCKLAKTC

SEQ ID NO: 250 - protein, 33 aa, Rana esculenta
GIMDTLKNLAKTAGKGALQSLLNKASCKLSGQC

SEQ ID NO: 251 - protein, 33 aa, Rana esculenta
GILDTLKNLAISAAKGAAQGLVNKASCKLSGQC

SEQ ID NO: 252 - protein, 33 aa, Rana esculenta
GILDTLKNLAKTAGKGALQGLVKMASCKLSGQC

SEQ ID NO: 253 - protein, 34 aa, Rana esculenta
GILLDKLKNFAKTAGKGVLQSLLNTASCKLSGQC

SEQ ID NO: 254 - protein, 29 aa, Rana esculenta
GILDSLKNLAKNAGQILLNKASCKLSGQC

SEQ ID NO: 255 - protein, 29 aa, Rana esculenta
GIFDKLKNFAKGVAQSLLNKASCKLSGQC

SEQ ID NO: 256 - protein, 74 aa, Rana esculenta
MFTMKKSLLLIFFLGTISLSLCQEERNADDDDGEMTEEEKRGIMDTLKNLAKTAGKGALQSLVKMASCKLSGQC

SEQ ID NO: 257 - protein, 33 aa, Rana temporaria
GLLSGLKKVGKHVAKNVAVSLMDSLKCKISGDC

SEQ ID NO: 258 - protein, 74 aa, Rana temporaria
MFTMKKSLLLFFFLGTISLSLCQEERNADEDDGEMTEEEKRGILDTLKHLAKTAGKGALQSLLNHASCKLSGQC

SEQ ID NO: 259 - protein, 29 aa, Rana temporaria
GLWETIKNFGKKFTLNILHKLKCKIGGGC

SEQ ID NO: 260 - protein, 29 aa, Rana temporaria
GLWETIKNFGKKFTLNILHNLKCKIGGGC

SEQ ID NO: 261 - protein, 129 aa, Bufo gargarizans
MSGRGKQGGKVRAKAKTRSSRAGLQFPVGRVHRLLRKGNYAQRVGAGAPVYLAAVLEYLTAEILELAGNAARDNKKTRIIPRHLQLAVRNDEELNKLLGGVTIAQGGVLPNIQAVLLPKTESSKPAKSK

SEQ ID NO: 262 - protein, 34 aa, Androctonus australis
SIVPIRCRSNRDCRRFCGFRGGRCTYARQCLCGY

SEQ ID NO: 263 - protein, 13 aa, Litoria chloris
MGLLDGLLGTLGL

SEQ ID NO: 264 - protein, 12 aa, Litoria xanthomera
GLLDGLLGTLGL

SEQ ID NO: 265 - protein, 13 aa, Litoria chloris
MGLLDGLLGGLGL

SEQ ID NO: 266 - protein, 12 aa, Litoria xanthomera
GLLDGLLGGLGL

SEQ ID NO: 267 - protein, 26 aa, Litoria caerulea
MGLLSVLGSVAKHVLPHVVPVIAEHL

SEQ ID NO: 268 - protein, 25 aa, Litoria splendida
GLLSVLGSVAKHVLPHVVPVIAEHL

SEQ ID NO: 269 - protein, 25 aa, Litoria chloris
MGLFSVLGAVAKHVLPHVVPVIAEK

SEQ ID NO: 270 - protein, 24 aa, Litoria xanthomera
GLFSVLGAVAKHVLPHVVPVIAEK

SEQ ID NO: 271 - protein, 25 aa, Litoria chloris
MGLFKVLGSVAKHLLPHVAPVIAEK

SEQ ID NO: 272 - protein, 24 aa, Litoria xanthomera
GLFKVLGSVAKHLLPHVAPVIAEK

SEQ ID NO: 273 - protein, 10 aa, Litoria xanthomera
QQDYTGWMDF

SEQ ID NO: 274 - protein, 172 aa, Mus musculus
MQFQRDVPSLWLWRSLSLLLLLGLGFSQTPSYRDAVLRAVDDFNQQSLDTNLYRLLDLDPEPQGDEDPDTPKSVRFRVKETVCGKAERQLPEQCAFKEQGVVKQCMGAVTLNPAADSFDISCNEPGAQPFRFKKISRLAGLLRKGGEKIGEKLKKIGQKIKNFFQKLVPQPE

SEQ ID NO: 275 - protein, 173 aa, Mus musculus
MQFQRDVPSLWLWRSLSLLLLLGLGFSQTPSYRDAVLRAVDDFNQQSLDTNLYRLLDLDPEPQGDEDPDTPKSVRFRVKETVCGKAERQLPEQCAFKEQGVVKQCMGAVTLNPAADSFDISCNEPGAQPFRFKKISRLAGLLRKGGEKIGEKLKKIGQKIKNFFQKLVPQPEQ

SEQ ID NO: 276 - protein, 160 aa, Ovis aries
METQRASLSLGRCSLWLLLLGLALPSASAQVLSYREAVLRAADQLNEKSSEANLYRLLELDPPPKQDDENSNIPKPVSFRVKETVCPRTSQQPAEQCDFKENGLLKECVGTVTLDQVRNNFDITCAEPQSVRGLRRLGRKIAHGVKKYGPTVLRIIRIAG

SEQ ID NO: 277 - protein, 160 aa, Ovis aries
METQRASLSLGRRSLWLLLLGLVLASASAQALSYREAVLRAVDQLNEKSSEANLYRLLELDPPPKQDDENSNIPKPVSFRVKETVCPRTSQQPAEQCDFKENGLLKECVGTVTLDQVGNNFDITCAEPQSVRGLRRLGRKIAHGVKKYGPTVLRIIRIAG

SEQ ID NO: 278 - protein, 160 aa, Ovis aries
METQRAGLSLGRRSLWLLLLGLVLASASAQALSYREAVLRAVDQLNEKSSEANLYRLLELDPPPKQDDENSNIPKPVSFRVKETVCPRTSQQPAEQCDFKENGLLKECVGTVTLDQVGNNFDITCAEPQSVRGLRRLGRKIAHGVKKYGPTVLRIIRIAG

SEQ ID NO: 279 - protein, 152 aa, Ovis aries
SLGRCSLWLLLLGLALPSASAQVLSYREAVLRAADQLNEKSSEANLYRLLELDPPPKQDDENSNIPKPVSFRVKETVCPRTSQQPAEQCDFKENGLLKECVGTVTLDQVRNNFDITCAEPQSVRGLRRLGRKIAHGVKKYGPTVLRIIRIAG

SEQ ID NO: 280 - protein, 35 aa, Bombyx mori
RWKIFKKIEKVGQNIRDGIVKAGPAVAVVGQAATI

SEQ ID NO: 281 - protein, 63 aa, Ceratitis capitata
MNFNKVFILVAIVIAIFAGQTEAGWLKKIGKKIERVGQHTRDATIQTIAVAQQAANVAATARG

SEQ ID NO: 282 - protein, 63 aa, Drosophila virilis
MNFYKVFIFVALILAISLGQSEAGWLKKIGKKIERIGQHTRDATIQGLGIAQQAANVAATARG

SEQ ID NO: 283 - protein, 63 aa, Ceratitis capitata
MNFNKVLVLLAVIFAVFAGQTEAGWLKKIGKKIERVGQHTRDATIQTIGVAQQAANVAATLKG

SEQ ID NO: 284 - protein, 63 aa, Drosophila virilis
MNFYKVFIFVALILAISLGQSEAGWLKKIGKKIERVGQHTRDATIQGLGIAQQAANVAATARG

SEQ ID NO: 285 - protein, 63 aa, Drosophila virilis
MNFYKVFIFVALILAISLGQSEAGWLKKIGKKIERIGQHTRDATIQGVGIAQQAANVAATARG

SEQ ID NO: 286 - protein, 59 aa, Aedes aegypti
MNFTKLFLLIAVAVLLLTGQSEAGGLKKLGKKLEGAGKRVFNAAEKALPVVAGAKALRK

SEQ ID NO: 287 - protein, 63 aa, Bombyx mori
MNFVRILSFVFALVLALGAVSAAPEPRWKLFKKIEKVGRNVRDGLIKAGPAIAVIGQAKSLGK

SEQ ID NO: 288 - protein, 62 aa, Trichoplusia ni
MNLVKILFCVFACLVFTVTAVPEPRWKFFKKIEKVGQNIRDGIIKAGPAVAVVGQAASITGK

SEQ ID NO: 289 - protein, 64 aa, Hyalophora cecropia
MNFSRIFFFVFACLTALAMVNAAPEPKWKLFKKIEKVGQNIRDGIIKAGPAVAVVGQATQIAKG

SEQ ID NO: 290 - protein, 57 aa, Spodoptera litura
IFFFVFACLLALSAVSAAPEPRWKVFKKIEKVGRNVRDGIIKAGPAIGVLGQAKALG

SEQ ID NO: 291 - protein, 63 aa, Drosophila melanogaster
MNFYNIFVFVALILAITIGQSEAGWLKKIGKKIERVGQHTRDATIQGLGIAQQAANVAATARG

SEQ ID NO: 292 - protein, 35 aa, Antheraea pernyi
KWKIFKKIEKVGRNIRNGIIKAGPAVAVLGEAKAL

SEQ ID NO: 293 - protein, 63 aa, Drosophila melanogaster
MNFNKIFVFVALILAISLGNSEAGWLRKLGKKIERIGQHTRDASIQVLGIAQQAANVAATARG

SEQ ID NO: 294 - protein, 58 aa, Spodoptera litura
ILSFVFACLLALSAVSAAPEPRWKVFKKIEKMGRNIRDGIVKAGPAIEVLGSAKALGK

SEQ ID NO: 295 - protein, 62 aa, Hyalophora cecropia
MNFSRIFFFVFALVLALSTVSAAPEPKWKVFKKIEKMGRNIRNGIVKAGPAIAVLGEAKALG

SEQ ID NO: 296 - protein, 63 aa, Bombyx mori
MNFAKILSFVFALVLALSMTSAAPEPRWKIFKKIEKMGRNIRDGIVKAGPAIEVLGSAKAIGK

SEQ ID NO: 297 - protein, 63 aa, Drosophila erecta
MNFNKIFVFVALILAISLGQSEAGWLKKLGKRIERIGQHTRDATIQGLGIAQQAANVAATARG

SEQ ID NO: 298 - protein, 63 aa, Drosophila mauritiana
MNFYKIFVFVALILAISIGQSEAGWLKKLGKRIERIGQHTRDATIQGLGIAQQAANVAATARG

SEQ ID NO: 299 - protein, 61 aa, Bombyx mori
MKFSKIFVFVFAIVFATASVSAAPGNFFKDLEKMGQRVRDAVISAAPAVDTLAKAKALGQG

SEQ ID NO: 300 - protein, 62 aa, Hyalophora cecropia
MNFTKILFFVVACVFAMRTVSAAPWNPFKELEKVGQRVRDAVISAGPAVATVAQATALAKGK

SEQ ID NO: 301 - protein, 31 aa, Sus scrofa
SWLSKTAKKLENSAKKRISEGIAIAIQGGPR

SEQ ID NO: 302 - protein, 29 aa, Ceratitis capitata
SIGSALKKALPVAKKIGKIALPIAKAALP

SEQ ID NO: 303 - protein, 71 aa, Ceratitis capitata
MANLKAVFLICIVAFIALQCVVAEPAAEDSVVVKRSIGSALKKALPVAKKIGKIALPIAKAALPVAAGLVG

SEQ ID NO: 304 - protein, 71 aa, Ceratitis capitata
MANLKAVFLICIVAFIAFQCVVAEPAAEDSIVVKRSIGSALKKALPVAKKIGKIALPIAKAALPVAAGLVG

SEQ ID NO: 305 - protein, 29 aa, Ceratitis capitata
SIGSAFKKALPVAKKIGKAALPIAKAALP

SEQ ID NO: 306 - protein, 67 aa, Ceratitis capitata
MANIKAVFLICIVAFIAFHCVVAEPTAEDSVVVKRSLGGVISGAKKVAKVAIPIGKAVLPVVAKLVG

SEQ ID NO: 307 - protein, 71 aa, Ceratitis capitata
MANLKAVFLICILAFIAFHCVVGAPTAEDSIVVKRSIGTAVKKAVPIAKKVGKVAIPIAKAVLSVVGQLVG

SEQ ID NO: 308 - protein, 137 aa, Chlamys islandica
MMYFVLFCLLAAGTTYGSHNFATGIVPHSCLECICKTESGCRAIGCKFDVYSDSCGYFQLKQAYWEDCGRPGGSLTSCADDIHCSSQCVQHYMSRYIGHTSCSRTCESYARLHNGGPHGCEHGSTLGYWGHVQGHGC

SEQ ID NO: 309 - protein, 449 aa, Bos taurus
MRSAAVLALLLCAGQVIALPVNSPMNKGDTEVMKCIVEVISDTLSKPSPMPVSKECFETLRGDERILSILRHQNLLKELQDLALQGAKERTHQQKKHSSYEDELSEVLEKPNDQAEPKEVTEEVSSKDAAEKRDDFKEVEKSDEDSDGDRPQASPGLGPGPKVEEDNQAPGEEEEAPSNAHPLASLPSPKYPGPQAKEDSEGPSQGPASREKGLSAEQGRQTEREEEEEKWEEAEAREKAVPEEESPPTAAFKPPPSLGNKETQRAAPGWPEDGAGKMGAEEAKPPEGKGEWAHSRQEEEEMARAPQVLFRGGKSGEPEQEEQLSKEWEDAKRWSKMDQLAKELTAEKRLEGEEEEEEDPDRSMRLSFRARGYGFRGPGLQLRRGWRPNSREDSVEAGLPLQVRGYPEEKKEEEGSANRRPEDQELESLSAIEAELEKVAHQLEELRRG

SEQ ID NO: 310 - protein, 170 aa, Bos taurus
MPVDIRNHNEEVVTHLRDPADTSEAPGLSAGEPPGSQVAKEAKTRYSKSEGQNREEEMVKYQKRERGEVGSEERLSEGPQRNQTPAKKSSQEGNPPLEEESHVGTGALEEGAERLPGELRNYLDYGEEKGEESAEFPDFYDSEEQMSPQHTAEDLELQKIAEKFSGTRRG

SEQ ID NO: 311 - protein, 25 aa, Pagrus major
FFGWLIKGAIHAGKAIHGLIHRRRH

SEQ ID NO: 312 - protein, 25 aa, Pagrus major
FFGWLIRGAIHAGKAIHGLIHRRRH

SEQ ID NO: 313 - protein, 20 aa, Pagrus major
FIGLLISAGKAIHDLIRRRH

SEQ ID NO: 314 - protein, 55 aa, Cicada flammata
NEYHGFVDKANNENKRKKQQGRDDFVVKPNNFANRRRKDDYNENYYDDVDAADVV

SEQ ID NO: 315 - protein, 16 aa, Litoria citropa
GLFDVIKKVASVIGGL

SEQ ID NO: 316 - protein, 18 aa, Litoria citropa
GLFDVIKKVASVIGLASP

SEQ ID NO: 317 - protein, 18 aa, Litoria citropa
GLFDVIKKVASVIGLASQ

SEQ ID NO: 318 - protein, 16 aa, Litoria citropa
GLFDIIKKVASVVGGL

SEQ ID NO: 319 - protein, 18 aa, Litoria citropa
GLFDIIKKVASVVGLASP

SEQ ID NO: 320 - protein, 18 aa, Litoria citropa
GLFDIIKKVASVVGLASQ

SEQ ID NO: 321 - protein, 16 aa, Litoria citropa
GLFDIIKKVASVIGGL

SEQ ID NO: 322 - protein, 26 aa, Litoria citropa
GLIGSIGKALGGLLVDVLKPKLQAAS

SEQ ID NO: 323 - protein, 24 aa, Litoria citropa
DLFQVIKEKLKELTGGVIEGIQGV

SEQ ID NO: 324 - protein, 80 aa, Styela clava
MKTTILILLILGLGINAKSLEERKSEEEKVFQFLGKIIHHVGNFVHGFSHVFGDDQQDNGKFYGHYAEDNGKHWYDTGDQ

SEQ ID NO: 325 - protein, 23 aa, Styela clava
VFQFLGRIIHHVGNFVHGFSHVF

SEQ ID NO: 326 - protein, 80 aa, Styela clava
MKTTILILLILGLGINAKSLEERKSEEEKVFHLLGKIIHHVGNFVYGFSHVFGDDQQDNGKFYGHYAEDNGKHWYDTGDQ

SEQ ID NO: 327 - protein, 80 aa, Styela clava
MKTTILILLILGLGINAKSLEERKSEEEKAFKLLGRIIHHVGNFVYGFSHVFGDDQQDNGKFYGHYAEDNGKHWYDTGDQ

SEQ ID NO: 328 - protein, 80 aa, Styela clava
MKTTILILLILGLGINAKSLEERKSEEEKLFKLLGKIIHHVGNFVHGFSHVFGDDQQDNGKFYGYYAEDNGKHWYDTGDQ

SEQ ID NO: 329 - protein, 74 aa, Zophobas atratus
SLQGGAPNFPQPSQQNGGWQVSPDLGRDDKGNTRGQIEIQNKGKDHDFNAGWGKVIRGPNKAKPTWHVGGTYRR

SEQ ID NO: 330 - protein, 93 aa, Oryctolagus cuniculus
MRTLILLAAILLAALQAQAELFSVNVDEVLDQQQPGSDQDLVIHLTGEESSALQVPDTKGICACRRRFCPNSERFSGYCRVNGARYVRCCSRR

SEQ ID NO: 331 - protein, 34 aa, Oryctolagus cuniculus
GRCVCRKQLLCSYRERRIGDCKIRGVRFPFCCPR

SEQ ID NO: 332 - protein, 95 aa, Oryctolagus cuniculus
MRTLALLAAILLVALQAQAEHVSVSIDEVVDQQPPQAEDQDVAIYVKEHESSALEALGVKAGVVCACRRALCLPRERRAGFCRIRGRIHPLCCRR

SEQ ID NO: 333 - protein, 95 aa, Oryctolagus cuniculus
MRTLALLAAILLVALQAQAEHISVSIDEVVDQQPPQAEDQDVAIYVKEHESSALEALGVKAGVVCACRRALCLPLERRAGFCRIRGRIHPLCCRR

SEQ ID NO: 334 - protein, 34 aa, Oryctolagus cuniculus
GICACRRRFCLNFEQFSGYCRVNGARYVRCCSRR

SEQ ID NO: 335 - protein, 32 aa, Oryctolagus cuniculus
MPCSCKKYCDPWEVIDGSCGLFNSKYICCREK

SEQ ID NO: 336 - protein, 13 aa, Vespa crabro
FLPLILRKIVTAL

SEQ ID NO: 337 - protein, 23 aa, Mus musculus
CKRRERMNGTCRKGHLLYTLCCR

SEQ ID NO: 338 - protein, 35 aa, Mus musculus
LRDLVCYCRARGCKGRERMNGTCRKGHLLYMLCCR

SEQ ID NO: 339 - protein, 35 aa, Mus musculus
  misc_feature (21)..(21): Xaa can be any naturally occurring amino acid
  misc_feature (35)..(35): Xaa can be any naturally occurring amino acid
LRDLVCYCRTRGCKRRERMNXTCRKGHLMYTLCCX

SEQ ID NO: 340 - protein, 93 aa, Mus musculus
MKKLVLLFALVLLGFQVQADSIQNTDEETKTEEQPGEEDQAVSVSFGDPEGTSLQEESLRDLVCYCRSRGCKGRERMNGTCRKGHLLYTLCCR

SEQ ID NO: 341 - protein, 35 aa, Mus musculus
LRDLVCYCRKRGCKGRERMNGTCRKGHLLYTLCCR

SEQ ID NO: 342 - protein, 92 aa, Mus musculus
KTLVLLSALVLLAFQVQADPIQNTDEETKTEEQPGEDDQAVSVSFGDPEGSSLQEESLRDLVCYCRKRGCKGRERMNGTCRKGHLLYTMCCR

SEQ ID NO: 343 - protein, 35 aa, Mus musculus
LRDLVCYCRSRGCKGRERMNGTCRKGHLLYMLCCR

SEQ ID NO: 344 - protein, 85 aa, Mus musculus
ALVLLAFQVQADPIQNTDEETKTEEQPGEEDQAVSVSFGDPEGTSLQEESLRDLVCYCRSRGCKGRERMNGTCRKGHLLYMLCCR

SEQ ID NO: 345 - protein, 35 aa, Mus musculus
LRDLVCYCRKRGCKRREHMNGTCRRGHLMYTLCCR

SEQ ID NO: 346 - protein, 93 aa, Mus musculus
MKTLVLLSALVLLAFQVQADPIQNTDEETKTEEQPGEEDQAVSVSFGDPEGTSLQEESLRDLVCYCRKRGCKRREHMNGTCRRGHLMYTLCCR

SEQ ID NO: 347 - protein, 85 aa, Mus musculus
ALVLLAFQVQADPIQNTDEETKTEEQPGEDDQAVSVSFGDPEGSSLQEESLRDLVCYCRTRGCKRRERMNGTCRKGHLMHTLCCR

SEQ ID NO: 348 - protein, 35 aa, Mus musculus
LRDLVCYCRKRGCKRREHINGTCRKGHLLYMLCCR

SEQ ID NO: 349 - protein, 93 aa, Mus musculus
MKTLVLLSALVLLAFQVQADPIQNTDEETKTEEQPGEDDQAVSVSFGDPEGSSLQEESLRDLVCYCRKRGCKRREHINGTCRKGHLLYMLCCR

SEQ ID NO: 350 - protein, 35 aa, Mus musculus
LRDLVCYCRSRGCKGRERMNGTCRKGHLMYTLCCR

SEQ ID NO: 351 - protein, 93 aa, Mus musculus
MKTLILLSALVLLAFQVQADPIQNTDEETKTEEQPGEEDQAVSVSFGDPEGTSLQEESLRDLVCYCRSRGCKGRERMNGTCRKGHLMYTLCCR

SEQ ID NO: 352 - protein, 82 aa, Mus musculus
LLAFQVQADPIQNTDEETKTEEQPGEEDQAVSVSFGDPEGTSLQEESLRDLVCYCRKRGCKRREHMNGTCRKGHLLYTLCCR

SEQ ID NO: 353 - protein, 35 aa, Mus musculus
  misc_feature (13)..(13): Xaa can be any naturally occurring amino acid
  misc_feature (23)..(23): Xaa can be any naturally occurring amino acid
  misc_feature (32)..(35): Xaa can be any naturally occurring amino acid
LRDLVCYCRARGXKGRERMNGTXRKGHLLYMXXXX

SEQ ID NO: 354 - protein, 93 aa, Mus musculus
MKPLVLLSALVLLSFQVQADPIQNTDEETKTEEQSGEEDQAVSVSFGDREGASLQEESLRDLVCYCRTRGCKRRERMNGTCRKGHLMYTLCCR

SEQ ID NO: 355 - protein, 93 aa, Mus musculus
MKTLVLLSALVLLAFQVQADPIQNTDEETKTEEQPGEDDQAVSVSFGDPEGSSLQEESLRDLVCYCRKRGCKRRERMNGTCRKGHLMYTLCCR

SEQ ID NO: 356 - protein, 34 aa, Mus musculus
LRGLLCYCRKGHCKRGERVRGTCGIRFLYCCPRR

SEQ ID NO: 357 - protein, 92 aa, Mus musculus
MKTLVLLSALVLLAFQVQADPIQNTDEETKTEEQPGEEDQAVSISFGGQEGSALHEKSLRGLLCYCRKGHCKRGERVRGTCGIRFLYCCPRR

SEQ ID NO: 358 - protein, 93 aa, Mus musculus
MKTFVLLSALVLLAFQVQADPIHKTDEETNTEEQPGEEDQAVSISFGGQEGSALHEELSKKLICYCRIRGCKRRERVFGTCRNLFLTFVFCCS

SEQ ID NO: 359 - protein, 93 aa, Mus musculus
MKTLILLSALVLLAFQVQADPIQNTDEETKTEEQPGEEDQAVSVSFGDPEGTSLQEESLRDLVCYCRARGCKGRERMNGTCRKGHLLYMLCCR

SEQ ID NO: 360 - protein, 35 aa, Mus musculus
LRDLVCYCRTRGCKRREHMNGTCRKGHLMYTLCCR

SEQ ID NO: 361 - protein, 93 aa, Mus musculus
MKTLILLSALVLLAFQVQADPIQNTDEETKTEEQPGEDDQAVSVSFGDPEGSSLQEESLRDLVCYCRTRGCKRREHMNGTCRKGHLMYTLCCR

SEQ ID NO: 362 - protein, 35 aa, Mus musculus
LRDLVCYCRKRGCKRREHMNGTCRKGHLMYTLCCR

SEQ ID NO: 363 - protein, 81 aa, Mus musculus
LAFQVQADPIQNTDEETKTEEQPGEDDQAVSVSFGDPEGSSLQEESLRDLVCYCRKRGCKRREHMNGTCRKGHLMYTLCCR

SEQ ID NO: 364 - protein, 35 aa, Mus musculus
LRDLVCYCRKRGCKRREHMNGTCRKGHLLYMLCCR

SEQ ID NO: 365 - protein, 93 aa, Mus musculus
MKTLVLLSALVLLAFQVQADPIQNTDEETKTEEQPGEEDQAVSVSFGDPEGSSLQEESLRDLVCYCRKRGCKRREHMNGTCRKGHLLYMLCCR

SEQ ID NO: 366 - protein, 116 aa, Mus musculus
MKTLVLLSALVLPCFQVQADPIQNTDEETKTEEQPEEEDQAVSVSFGGTEGSALQDVAQRRFPWCRKCRVCQKCQVCQKCPVCPTCPQCPKQPLCEERQNKTAITTQAPNTQHKGC

SEQ ID NO: 367 - protein, 91 aa, Mus musculus
MKKLVLLFALVLLAFQVQADSIQNTDEETKTEEQPGEKDQAVSVSFGDPQGSALQDAALGWGRRCPQCPRCPSCPSCPRCPRCPRCKCNPK

SEQ ID NO: 368 - protein, 91 aa, Mus musculus [sequence omitted]

SEQ ID NO: 369 - protein, 91 aa, Mus musculus
MKKLVLLSAFVLLAFQVQADSIQNTDEETKTEEQPGEENQAMSVSFGDPEGSALQDAAVGMARPCPPCPSCPSCPWCPMCPRCPSCKCNPK

SEQ ID NO: 370 - protein, 91 aa, Mus musculus
MKKLVLLSAFVLLAFQVQADSIQNTDEEIKTEEQPGEENQAVSISFGDPEGYALQDAAIRRARRCPPCPSCLSCPWCPRCLRCPMCKCNPK

SEQ ID NO: 371 - protein, 155 aa, Bos taurus
METPRASLSLGRWSLWLLLLGLALPSASAQALSYREAVLRAVDQLNEQSSEPNIYRLLELDQPPQDDEDPDSPKRVSFRVKETVCSRTTQQPPEQCDFKENGLLKRCEGTVTLDQVRGNFDITCNNHQSIRITKQPWAPPQAARLCRIVVIRVCR

SEQ ID NO: 372 - protein, 155 aa, Ovis aries
METQRASLSLGRCSLWLLLLGLALPSASAQVLSYREAVLRAVDQLNEQSSEPNIYRLLELDQPPQDDEDPDSPKRVSFRVKETVCPRTTQQPPEQCDFKENGLLKRCEGTVTLDQVRGNFDITCNNHQSIRITKQPWAPPQAARICRIIFLRVCR

SEQ ID NO: 373 - protein, 68 aa, Cercopithecus aethiops
MRTSYLLLFTLCLLLSEMASGDNFLTGLGHRSDHYNCVRSGGQCLYSACPIYTKIQGTCYHGKAKCCK

SEQ ID NO: 374 - protein, 68 aa, Cercopithedus erythrogaster
MRTSYLLLFTLCLLLSEMASGDNFLTGLGHRSDHYICVRSGGQCLYSACPIYTKIQGTCYHGKAKCCK

SEQ ID NO: 375 - protein, 68 aa, Gorilla gorilla
MRTSYLLLFTLCLLLSEIASGGNFLTGLGHRSDHYNCVSSGGQCLYSACPIFTKIQGTCYGGKAKCCK

SEQ ID NO: 376 - protein, 68 aa, Hylobates concolor
MRTSYLLLFTLCLLLSEMASGDNFLTGLGHRSDHYNCVRSGGQCLYSACPIYTKIQGTCYQGKAKCCK

SEQ ID NO: 377 - protein, 68 aa, Pan troglodytes
MRTSYLLLFTLCLLLSEMASGGNFLTGLGHRSDHYNCVSSGGQCLYSACPIFTKIQGTCYGGKAKCCK

SEQ ID NO: 378 - protein, 68 aa, Presbytis obscura
MRTSYLLLFTLCLLMSEMASGDNFLTGLGHRSDHYNCVRSGGQCLYSACPIYTKIQGTCYHGKAKCCK

SEQ ID NO: 379 - protein, 68 aa, Saguinus oedipus
MRTSYLLLFILCLVLCDMDSGDTFLTGLGHRSDHYNCVKGGGQCLYSACPIYTKVQGTCYGGKAKCCK

SEQ ID NO: 380 - protein, 43 aa, Mus musculus
MKLLLLTLAALLLVSQLTPGDAQKCWNLHGKCRHRCSRKESVY

SEQ ID NO: 381 - protein, 38 aa, Aeshna cyanea
GFGCPLDQMQCHRHCQTITGRSGGYCSGPLKLTCTCYR

SEQ ID NO: 382 - protein, 43 aa, Allomyrina dichotoma
VTCDLLSFEAKGFAANHSLCAAHCLAIGRRGGSCERGVCICRR

SEQ ID NO: 383 - protein, 102 aa, Anopheles gambiae
MKCATIVCTIAVVLAATLLNGSVQAAPQEEAALSGGANLNTLLDELPEETHHAALENYRAKRATCDLASGFGVGNNLCAAHCIARRYRGGYCNSKAVCVCRN

SEQ ID NO: 384 - protein, 131 aa, Anopheles gambiae
NSRVNGATPAKLKLVLLCLPRASSSPQLIMKCATIVCTIAVVLAATLLNGSVQAAPQEEAALSGGANLNTLLDELPEETHHAALENYRAKRATCDLASGFGVGSSLCAAHCIARRYRGGYCNSKAVCVCRN

SEQ ID NO: 385 - protein, 51 aa, Bombus pascuorum
VTCDLLSIKGVAEHSACAANCLSMGKAGGRCENGICLCRKTTFKELWDKRF

SEQ ID NO: 386 - protein, 117 aa, Branchiostoma belcheri
MEKKTAYCLLFLVLLVPYTALGAVLKRAPAKKEKRAVPLAVPLVYWGASVSPAVWNWLLVTFGAAAVAAAAVTVSDNDSHSCANNRGWCRSRCFSHEYIDSWHSDVCGSYDCCRPRY

SEQ ID NO: 387 - protein, 92 aa, Drosophila melanogaster
MKFFVLVAIAFALLACMAQAQPVSDVDPIPEDHVLVHEDAHQEVLQHSRQKRATCDLLSKWNWNHTACAGHCIAKGFKGGYCNDKAVCVCRN

SEQ ID NO: 388 - protein, 92 aa, Drosophila melanogaster
MKFFVLVAIAFALLACMAQAQPVSDVDPIPEDHVLVHEDANQEVLQHSRQKRATCDLLSKWNWNHTACAGHCIAKGFKGGYCNDKAVCVCRN

SEQ ID NO: 389 - protein, 92 aa, Drosophila melanogaster
MKFFVLVAIAFALLTCMAQAQPVSDVDPIPEDHVLVHEDAHQEVLQHSRQKRATCDLLSKWNWNHTACAGHCIAKGFKGGYCNDKAVCVCRN

SEQ ID NO: 390 - protein, 92 aa, Drosophila melanogaster
MKFFVPVAIAFALLACVAQAQPVSDVDPIPEDHVLVHDDAHQEVLQHSRQKRATCDLLSKWNWNHTACAGHCIAKGFKGGYCNDKAVCVCRN

SEQ ID NO: 391 - protein, 92 aa, Drosophila simulans
MKFFVLVAIAFALLACMAQAQPVSDVDPIPEDHALVHEDAHQEVVQHSRQKRATCDLLSKWNWNHTACAGHCIAKGFKGGYCNDKAVCVCRN

SEQ ID NO: 392 - protein, 98 aa, Mamestra brassicae
MLCLADIRIVASCSAAIKSGYGQQPWLAHVAGPYANSLFDDVPADSYHAAVEYLRLIPASCYLLDGYAAGRDDGRAHCIAPRNRRLYCASYQVCVCRY

SEQ ID NO: 393 - protein, 92 aa, Musca domestica
MKYFTMFAFFFVAVCYISQSSASPAPKEEANFVHGADALKQLEPELHGRYKRATCDLLSGTGVGHSACAAHCLLRGNRGGYCNGKGVCVCRN

SEQ ID NO: 394 - protein, 73 aa, Ornithodoros moubata
MNKLFIVALVLALAVATMAHEVHDDIEEPSVPRVRRGFGCPFNQYECHAHCSGVPGYKGGYCKGLFKQTCNCY

SEQ ID NO: 395 - protein, 73 aa, Ornithodoros moubata
MNKLFIVALVLALAVATMAHEVYDDVEEPSVPRVRRGYGCPFNQYQCHSHCSGIRGYKGGYCKGLFKQTCNCY

SEQ ID NO: 396 - protein, 43 aa, Palomena prasina
ATCDALSFSSKWLTVNHSACAIHCLTKGYKGGRCVNTICNCRN

SEQ ID NO: 397 - protein, 40 aa, Phlebotomus duboscqi
ATCDLLSAFGVGHAACAAHCIGHGYRGGYCNSKAVCTCRR

SEQ ID NO: 398 - protein, 55 aa, Pyrocoelia rufa
MKLSVFVLVAVMLVLLCCAMQTEARRRCRSCVPFCGSNERMISTCFSGGVVCCPR

SEQ ID NO: 399 - protein, 43 aa, Pyrrhocoris apterus
ATCDILSFQSQWVTPNHAGCALHCVIKGYKGGQCKITVCHCRR

SEQ ID NO: 400 - protein, 57 aa, Aedes albopictus
DELPEETYQAAVENYRRKRATCDLLSGFGVGDSACAAHCIARRNRGGYCNAKTVCVC

SEQ ID NO: 401 - protein, 57 aa, Apis mellifera
FEPLEHFENEERADRHRRVTCDLLSFKGQVNDSACAANCHSLGKAGGHCEKGVCICR

SEQ ID NO: 402 - protein, 39 aa, Stomoxys calcitrans
ATCDLLSGMGVNHSACAAHCVLRGNRGGYCNSKAVCVCR

SEQ ID NO: 403 - protein, 83 aa, Acalolepta luxuriosa
MKFFITFTFVLSLVVLTVYSAPREFAEPEEQDEGHFRVKRFTCDVLSVEAKGVKLNHAACGIHCLFRRRTGGYCNKKRVCICR

SEQ ID NO: 404 - protein, 79 aa, Stomoxys calcitrans
MKFLNVVAIALLVVACLAVYSNAAPHEGVKEVAAAKPMGITCDLLSLWKVGHAACAAHCLVLGDVGGYCTKEGLCVCKE

SEQ ID NO: 405 - protein, 79 aa, Stomoxys calcitrans
MKFLNVVAIALLVVACLSVYSNAAPHEGVKEVAAAKPMGITCDLLSLWKVGHAACAAHCLVLGNVGGYCTKEGLCVCKE

SEQ ID NO: 406 - protein, 97 aa, Stomoxys calcitrans
MKFFSLFPVIVVVVACLTMRANAAPSAGNEVDHHPDYVDGVEALRQLEPELHGRYKRATCDLLSMWNVNHSACAAHCLLLGKSGGRCNDDAVCVCRK

SEQ ID NO: 407 - protein, 97 aa, Stomoxys calcitrans
MKFFSLFPVILVVVACLTMRANAAPSAGDEVDHHPDYVDGVEALRQLEPELHGRYKRATCDLLSMWNVNHSACAAHCLLLGKSGGRCNDDAVCVCRK

SEQ ID NO: 408 - protein, 93 aa, Rattus norvegicus
MKKLVLLSALVLLALQVEAEPTPKTDEGTKTDEQPGKEDQVVSVSIEGQGDPAFQDAVLRDLKCFCRRKSCNWGEGIMGICKKRYGSPILCCR

SEQ ID NO: 409 - protein, 98 aa, Aedes aegypti
MQSLTVICFLALCTGAITSAYPQEPVLADEARPFANSLFDELPEETYQAAVENFRLKRATCDLLSGFGVGDSACAAHCIARGNRGGYCNSKKVCVCRN

SEQ ID NO: 410 - protein, 37 aa, Mytilus edulis
  misc_feature (21)..(21): Xaa can be any naturally occurring amino acid
  misc_feature (28)..(28): Xaa can be any naturally occurring amino acid
GFGCPNDYPCHRHCKSIPGRXGGYCGGXHRLRCTCYR

SEQ ID NO: 411 - protein, 73 aa, Ornithodoros moubata
MNKLFIVALVVALAVATMAQEVHNDVEEQSVPRVRRGYGCPFNQYQCHSHCSGIRGYKGGYCKGTFKQTCKCY

SEQ ID NO: 412 - protein, 94 aa, Rhodnius prolixus
MKCILSLVTLFLVAVLVHSHPAEWNTHQQLDDALWEPAGEVTEEHVARLKRATCDLFSFRSKWVTPNHAACAAHCLLRGNRGGRCKGTICHCRK

SEQ ID NO: 413 - protein, 37 aa, Aedes aegypti
MKSLTVICFLALCTGAITSAYPQEPVLADEARPFANS

SEQ ID NO: 414 - protein, 37 aa, Aedes aegypti
MQSLTVICFLALCTGAITSAYPQEPVLADEARPFANS

SEQ ID NO: 415 - protein, 37 aa, Aedes aegypti
MQPLTVICFLALCTGAITSAYPQEPVLADEARPFANS

SEQ ID NO: 416 - protein, 98 aa, Aedes aegypti
MKSITVICFLALCTVAITSAYPQEPVLADEARPFANSLFDELPEETYQAAVENFRLKRATCDLLSGFGVGDSACAAHCIARGNRGGYCNSKKVCVCRN

SEQ ID NO: 417 - protein, 98 aa, Aedes aegypti
MQSITVICFLALCTGAITSAYPQEPVLADEARPFANSLFDELPEETYQAAVENFRLKRATCDLLSGFGVGDSACAAHCIARGNRGGYCNSKKVCVCRN

SEQ ID NO: 418 - protein, 30 aa, Macaca mulatta
ACYCRIPACLAGERRYGTCFYLGRVWAFCC

SEQ ID NO: 419 - protein, 30 aa, Macaca mulatta
ACYCRIPACLAGERRYGTCFYRRRVWAFCC

SEQ ID NO: 420 - protein, 33 aa, Macaca mulatta
RRTCRCRFGRCFRRESYSGSCNINGRIFSLCCR

SEQ ID NO: 421 - protein, 32 aa, Macaca mulatta
RTCRCRFGRCFRRESYSGSCNINGRIFSLCCR

SEQ ID NO: 422 - protein, 33 aa, Macaca mulatta
RRTCRCRFGRCFRRESYSGSCNINGRISSLCCR

SEQ ID NO: 423 - protein, 32 aa, Macaca mulatta
RTCRCRFGRCFRRESYSGSCNINGRISSLCCR

SEQ ID NO: 424 - protein, 40 aa, Aedes aegypti
ATCDLLSGFGVGDSACAAHCIARGNRGGYCNSQKVCVCRN

SEQ ID NO: 425 - protein, 73 aa, Ornithodoros moubata
MNKLFIVALVVALAVATMAQEVHDDVEEQSVPRVRRGYGCPFNQYQCHSHCRGIRGYKGGYCTGRFKQTCKCY

SEQ ID NO: 426 - protein, 94 aa, Rhodnius prolixus
MKCILSLVTLFLVAVLVHSHPAEWNTQQELDDALWEPAGEVTEEHVARLKRATCDLLSFSSKWVTPNHAGCAAHCLLRGNRGGHCKGTICHCRK

SEQ ID NO: 427 - protein, 35 aa, Mytilus edulis
  misc_feature (28)..(28): Xaa can be any naturally occurring amino acid
GFGCPNDYPCHRHCKSIPGRYGGYCGGXHRLRCTC

SEQ ID NO: 428 - protein, 67 aa, Mus musculus
MRLHYLLFVFLILFLVPAPGDAFLPKTLRKFFCRIRGGRCAVLNCLGKEEQIGRCSNSGRKCCRKKK

SEQ ID NO: 429 - protein, 81 aa, Mus musculus
MKTFLFLFAVLFFWSQPRMHFFFFDEKCSRINGRCTASCLKNEELVALCWKNLKCCVTVQSCGRSKGNQSDEGSGHMGTRG

SEQ ID NO: 430 - protein, 62 aa, Mus musculus
MKFSYFLLLLLSLSNFQNNPVAMLDTIACIENKDTCRLKNCPRLHNVVGTCYEGKGKCCHKN

SEQ ID NO: 431 - protein, 63 aa, Mus musculus
MKISCFLLLILSLYFFQINQAIGPDTKKCVQRKNACHYFECPWLYYSVGTCYKGKGKCCQKRY

SEQ ID NO: 432 - protein, 73 aa, Mus musculus
MKISCFLLMIFFLSCFQINPVAVLDTIKCLQGNNNCHIQKCPWFLLQVSTCYKGKGRCCQKRRWFARNHVYHV

SEQ ID NO: 433 - protein, 64 aa, Mus musculus
MRIHYLLFAFLLVLLCPLASDFSKTINNPVSCCMIGGICRYLCKGNILQNGNCGVTSLNCCKRK

SEQ ID NO: 434 - protein, 94 aa, Rhodnius prolixus
MKCILSLFTLFLVATLVYSYPAEWNSQHQLDDAQWEPAGELTEEHLSRMKRATCDLLSLTSKWFTPNHAGCAAHCIFLGNRGGRCVGTVCHCRK

SEQ ID NO: 435 - protein, 43 aa, Zophobas atratus
FTCDVLGFEIAGTKLNSAACGAHCLALGRTGGYCNSKSVCVCR

SEQ ID NO: 436 - protein, 99 aa, Aedes aegypti
MRTLIVVCFVALCLSAIFTTGSALPGELADDVRPYANSLFDELPEESYQAAVENFRLKRATCDLLSGFGVGDSACAAHCIARRNRGGYCNAKKVCVCRN

SEQ ID NO: 437 - protein, 96 aa, Aedes albopictus
VPTVICFLAMCLVAITGAYPQEPVLADEAQSVANSLFDELPEESYQAAVENLRLKRATCDLLSGFGVGDSACAAHCIARGNRGGYCNSKKVCVCPI

SEQ ID NO: 438 - protein, 44 aa, Heliothis virescens
DKLIGSCVWGAVNYTSDCNGECKRRGYKGGHCGSFANVNCWCET

SEQ ID NO: 439 - protein, 44 aa, Heliothis virescens
DKLIGSCVWGAVNYTSDCNGECLLRGYKGGHCGSFANVNCWCET

SEQ ID NO: 440 - protein, 98 aa, Aedes aegypti
MKSITVICFLALCTGSITSAYPQDPVLADEARPFANSLFDELPEETYQAAVENFRLKRATCDLLSGFGVGDSACAAHCIARGNRGGYCNSKKVCVCRN

SEQ ID NO: 441 - protein, 98 aa, Aedes aegypti
MKSITVICFLALCTVAITSAYPQEPVLADEARPFANSLFDELPEETYQAAVENFRLKRATCDLLSGFGVGDSACAAHCIARGNRGGYCNSQKVCVCRN

SEQ ID NO: 442 - protein, 98 aa, Aedes aegypti
MKSITVICFLALCTGSITSAYPQEPVLADEARPFANSLFDELPEETYQAAVENFRLKRATCDLLSGFGVGDSACAAHCIARGNRGGYCNSQKVCVCRN

SEQ ID NO: 443 - protein, 99 aa, Aedes aegypti
MRTLIVVCFVALCLSAIFTTGSALPEELADDVRSYANSLFDELPEESYQAAVENFRLKRATCDLLSGFGVGDSACAAHCIARRNRGGYCNAKKVCVCRN

SEQ ID NO: 444 - protein, 39 aa, Mytilus galloprovincialis
GFGCPNNYQCHRHCKSIPGRCGGYCGGWHRLRCTCYRCG

SEQ ID NO: 445 - protein, 38 aa, Mytilus galloprovincialis
  misc_feature (28)..(28): Xaa can be any naturally occurring amino acid
GFGCPNNYQCHRHCKSIPGRCGGYCGGXHRLRCTCYRC

SEQ ID NO: 446 - protein, 81 aa, Mytilus galloprovincialis
MKAAFVLLVVGLCIMTDVATAGFGCPNNYACHQHCKSIRGYCGGYCAGWFRLRCTCYRCGGRRDDVEDIFDIYDNVAVERF

SEQ ID NO: 447 - protein, 32 aa, Rattus norvegicus
VTCYCRRTRCGFRERLSGACGYRGRIYRLCCR

SEQ ID NO: 448 - protein, 31 aa, Rattus norvegicus
ACYCRIGACVSGERLTGACGLNGRIYRLCCR

SEQ ID NO: 449 - protein, 102 aa, Anopheles gambiae
MKCATIVCTIAVVLAATLLNGSVQAAPQEEAALSGGANLNTLLDELPEETHHAALENYRAKRATCDLASGFGVGSSLCAAHCIARRYRGGYCNSKAVCVCRN

SEQ ID NO: 450 - protein, 92 aa, Drosophila melanogaster
MKFFVLVAIAFALLACVAQAQPVSDVDPIPEDHVLVHEDAHQEVLQHSRQKRATCDLLSKWNWNHTACAGHCIAKGFKGGYCNDKAVCVCRN

SEQ ID NO: 451 - protein, 79 aa, Oryctes rhinoceros
MSRFIVFAFIVAMCIAHSLAAPAPEALEASVIRQKRLTCDLLSFEAKGFAANHSLCAAHCLAIGRKGGACQNGVCVCRR

SEQ ID NO: 452 - protein, 102 aa, Spodoptera frugiperda
MGVKVINVFLLIAVSACLIHAVAGKPNPRDSSVVEEQSLGPIHNEDLEVKVKPETTTTPEPRIPGRVSCDFEEANEDAVCQEHCLPKGYTYGICVSHTCSCI

SEQ ID NO: 453 - protein, 40 aa, Culex pipiens
ATCDLLSGFGVNDSACAAHCILRGNRGGYCNGKKVCVCRN

SEQ ID NO: 454 - protein, 31 aa, Rattus norvegicus
VTCSCRTSSCRFGERLSGACRLNGRIYRLCC

SEQ ID NO: 455 - protein, 32 aa, Rattus norvegicus
VTCYCRSTRCGFRERLSGACGYRGRIYRLCCR

SEQ ID NO: 456 - protein, 92 aa, Mus musculus
MKKLVLLSAFVLLAFQVQADSIQNTDEEIKTEEQPGEENQAVSISFGDPEGYALQDAAAIRRARRCPPCPSCLSCPWCPRCLRCPMCKCNPK

SEQ ID NO: 457 - protein, 92 aa, Mus musculus
MKKLVLLFALVLLAFQVQADSIQNTDEETKTEEQQGEEDQAVSVSFGDPQGSGLQDAAALGWGRRCPRCPPCPRCSWCPRCPTCPRCNCNPK

SEQ ID NO: 458 - protein, 60 aa, Mus musculus
MRIHYLLFTFLLVLLSPLAAFSQKINDPVTYIRNGGICQYRCIGLRHKIGTCGSPFKCCK

SEQ ID NO: 459 - protein, 43 aa, Zophobas atratus
FTCDVLGFEIAGTKLNSAACGAHCLALGRRGGYCNSKSVCVCR

SEQ ID NO: 460 - protein, 96 aa, Macaca mulatta
MRTLVILAAILLVALQAQAEPLQARTDEATAAQEQIPTDNPEVVVSLAWDESLAPKDSVPGLRKNMACYCRIPACLAGERRYGTCFYRRRVWAFCC

SEQ ID NO: 461 - protein, 96 aa, Macaca mulatta
MRTLVILAAILLVALQAQAEPLQARTDEATAAQEQIPTDNPEVVVSLAWDESLAPKDSVPGLRKNMACYCRIPACLAGERRYGTCFYLRRVWAFCC

SEQ ID NO: 462 - protein, 5 aa, Mus musculus
ICSPK

SEQ ID NO: 463 - protein, 42 aa, Ornithorhynchus anatinus
FVQHRPRDCESINGVCRHKDTVNCREIFLADCYNDGQKCCRK

SEQ ID NO: 464 - protein, 42 aa, Ornithorhynchus anatinus
IMFFEMQACWSHSGVCRDKSERNCKPMAWTYCENRNQKCCEY

SEQ ID NO: 465 - protein, 38 aa, Ornithorhynchus anatinus
FEMQYCWSHSGVCRDKSERNNKPMAWTYCENRQKKCEF

SEQ ID NO: 466 - protein, 61 aa, Mesobuthus martensi
MTYAILIIVSLLPISDGISNVVDKYCSENPLDCNEHCLKTKNQIGICHGANGNEKCSCMES

SEQ ID NO: 467 - protein, 76 aa, Macaca mulatta
MRTFALLTAMLLLVALHAQAEARQARADEAAAQQQPGADDQGMAHSFTWPENAALPLSESAKGLRCICTRGFCRLL

SEQ ID NO: 468 - protein, 76 aa, Macaca mulatta
MRTLALHTAMLLLVALHAQAEARQARADEAAAQQQPGADDQGMAHSFTWPENAALPLSESERGLRCICVLGICRLL

SEQ ID NO: 469 - protein, 34 aa, Phyllomedusa sauvagei
ALWKTMLKKLGTMALHAGKAALGAAADTISQGTQ

SEQ ID NO: 470 - protein, 78 aa, Phyllomedusa bicolor
MDILKKSLFLVLFLGLVSLSICEEEKRENEDEEKQDDEQSEMKRAMWKDVLKKIGTVALHAGKAALGAVADTISQGEQ

SEQ ID NO: 471 - protein, 77 aa, Phyllomedusa bicolor
MAFLKKSLFLVLFLGLVSLSVCEEEKRENEDEEEQEDDEQSEEKRALWKTIIKGAGKMIGSLAKNLLGSQAQPESEQ

SEQ ID NO: 472 - protein, 77 aa, Phyllomedusa bicolor
MAFLKKSLFLVLFLGLVPLSLCESEKREGENEEEQEDDQSEEKRSLGSFLKGVGTTLASVGKVVSDQFGKLLQAGQG

SEQ ID NO: 473 - protein, 82 aa, Protophormia terraenovae
DEKPKLILPTPAPPNLPQLVGGGGGNRKDGFGVSVDAHQKVWTSDNGGHSIGVSPGYSQHLPGPYGNSRPDYRIGAGYSYNF

SEQ ID NO: 474 - protein, 41 aa, Protophormia terraenovae
  misc_feature (11)..(11): Xaa can be any naturally occurring amino acid
  misc_feature (29)..(29): Xaa can be any naturally occurring amino acid
  misc_feature (31)..(32): Xaa can be any naturally occurring amino acid
DEKPKLVLPSXAPPNLPQLVGGGGGNNKXGXXVSINAAQKV

SEQ ID NO: 475 - protein, 39 aa, Protophormia terraenovae
  misc_feature (8)..(8): Xaa can be any naturally occurring amino acid
  misc_feature (10)..(11): Xaa can be any naturally occurring amino acid
  misc_feature (14)..(14): Xaa can be any naturally occurring amino acid
  misc_feature (17)..(17): Xaa can be any naturally occurring amino acid
  misc_feature (30)..(31): Xaa can be any naturally occurring amino acid
  misc_feature (34)..(34): Xaa can be any naturally occurring amino acid
  misc_feature (36)..(37): Xaa can be any naturally occurring amino acid
DEKPKLIXPXXAPXNLXQLVGGGGGNNKKXXGVXVXXAQ

SEQ ID NO: 476 - protein, 101 aa, Protophormia terraenovae
MKLFYLLVICALSLAVMADEKPKLILPTPAPPNLPQLVGGGGGNRKDGFGVSVDAHQKVWTSDNGRHSIGVTPGYSQHLGGPYGNSRPDYRIGAGYSYNFG

SEQ ID NO: 477 - protein, 33 aa, Dolabella auricularia
SHQDCYEALHKCMASHSKPFSCSMKFHMCLQQQ

SEQ ID NO: 478 - protein, 64 aa, Drosophila melanogaster
MKFTIVFLLLACVFAMAVATPGKPRPYSPRPTSHPRPIRVRREALAIEDHLTQAAIRPPPILPA

SEQ ID NO: 479 - protein, 64 aa, Drosophila melanogaster
MKFTIVFLLLACVFAMAVATPGKPRPYSPRPTSHPRPIRVRREALAIEDHLTQAAIRPPPILPV

SEQ ID NO: 480 - protein, 64 aa, Drosophila melanogaster
MKFTIVFLLLACVFAMGVATPGKPRPYSPRPTSHPRPIRVRREALAIEDHLTQAAIRPPPILPA

SEQ ID NO: 481 - protein, 64 aa, Drosophila melanogaster
MKFTIVFLLLACVFAMAVATPGKPRPYSPRPTSHPRPIRVRREALAIEDHLAQAAIRPPPILPA

SEQ ID NO: 482 - protein, 44 aa, Drosophila melanogaster
DCLSGRYKGPCAVWDNETCRRVCKEEGRSSGHCSPSLKCWCEGC

SEQ ID NO: 483 - protein, 70 aa, Drosophila melanogaster
MMQIKYLFALFAVLMLVVLGANEADADCLSGRYKGPCAVWDNETCRRVCKEEGRSSGHCSPSLKCWCEGC

SEQ ID NO: 484 - protein, 59 aa, Bombyx mori
MNFTRIIFFLGVVVFATASGKPWNIFKEIERAVARTRDAVISAGPAVATVAAATSVASG

SEQ ID NO: 485 - protein, 32 aa, Sus scrofa
RADTQTYQPYNKDWIKEKIYVLLRRQAQQAGK

SEQ ID NO: 486 - protein, 64 aa, Bubalus bubalis
MRLHHLLLALLFLVLSAGSGFTQGVRNPQSCHRNKGICVPIRCPGNMRQIGTCLGPPVKCCRRK

SEQ ID NO: 487 - protein, 64 aa, Bos taurus
MRLHHLLLTLLFLVLSAGSGFTQGISNPLSCRLNRGICVPIRCPGNLRQIGTCFTPSVKCCRWR

SEQ ID NO: 488 - protein, 233 aa, Cavia porcellus
MKLLLLLALLLGAVSTRHLKVDTSSLQSLRGEESLAQDGETAEGATREATAGALMPLPEEEEMEGASGSEDDPEEEEEEEEEVEFSSELDVSPEDIQCPKEEDTVKFFSRPGYKTRGYVMVGSARTFNEAQWVCQRCYRGNLASIHSFAFNYQVQCTSAGLNVAQVWIGGQLRGKGRCRRFVWVDRTVWNFAYWARGQPWGGRQRGRCVTLCARGGHWRRSHCGKRRPFVCTY

SEQ ID NO: 489 - protein, 69 aa, Mus musculus
MKVLLLFAVFFCFVQGNSGDIPPGIRNTVCLMQQGHCRLFMCRSGERKGDICSDPWNRCCVPYSVKDRR

SEQ ID NO: 490 - protein, 46 aa, Rana esculenta
GIFSKLGRKKIKNLLISGLKNVGKEVGMDVVRTGIDIAGCKIKGEC

SEQ ID NO: 491 - protein, 46 aa, Rana esculenta
GIFSKLAGKKIKNLLISGLKNVGKEVGMDVVRTGIDIAGCKIKGEC

SEQ ID NO: 492 - protein, 84 aa, Rana esculenta
MFTLKKPLLLIVLLGMISLSLCEQERNADEEEGSEIKRGIFSKLAGKKLKNLLISGLKNVGKEVGMDVVRTGIDIAGCKIKGEC

SEQ ID NO: 493 - protein, 37 aa, Rana esculenta
GILSLVKGVAKLAGKGLAKEGGKFGLELIACKIAKQC

SEQ ID NO: 494 - protein, 37 aa, Rana berlandieri
GLFSILRGAAKFASKGLGKDLTKLGVDLVACKISKQC

SEQ ID NO: 495 - protein, 37 aa, Rana esculenta
GIFSLVKGAAKLAGKGLAKEGGKFGLELIACKIAKQC

SEQ ID NO: 496 - protein, 37 aa, Rana luteiventris
GILSLFTGGIKALGKTLFKMAGKAGAEHLACKATNQC

SEQ ID NO: 497 - protein, 37 aa, Rana pipiens
GFSSIFRGVAKFASKGLGKDLARLGVNLVACKISKQC

SEQ ID NO: 498 - protein, 16 aa, Myrmecia gulosa
GRPNPVNNKPTPHPRL

SEQ ID NO: 499 - protein, 16 aa, Myrmecia gulosa
GRPNPVNTKPTPYPRL

SEQ ID NO: 500 - protein, 33 aa, Rana rugosa
SLFSLIKAGAKFLGKNLLKQGACYAACKASKQC

SEQ ID NO: 501 - protein, 33 aa, Rana rugosa
GIMSIVKDVAKNAAKEAAKGALSTLSCKLAKTC

SEQ ID NO: 502 - protein, 33 aa, Rana rugosa
GIMSIVKDVAKTAAKEAAKGALSTLSCKLAKTC

SEQ ID NO: 503 - protein, 80 aa, Rana rugosa
MFTMKKSLLFLFFLGTISLSLCEEERSADEDDGGEMTEEEVKRGILDTLKQFAKGVGKDLVKGAAQGVLSTVSCKLAKTC

SEQ ID NO: 504 - protein, 65 aa, Rana rugosa
MFTLKKSLLLLFFLGTISLSLCEEERNADEEEKRDVEVEKRFLGALFKVASKVLPSVFCAITKKC

SEQ ID NO: 505 - protein, 24 aa, Rana rugosa
FLPLLAGLAANFLPTIICKISYKC

SEQ ID NO: 506 - protein, 65 aa, Gallus gallus
MRIVYLLLPFILLLAQGAAGSSQALGRKSDCFRKNGFCAFLKCPYLTLISGKCSRFHLCCKRIWG

SEQ ID NO: 507 - protein, 39 aa, Gallus gallus
GRKSDCFRKSGFCAFLKCPSLTLISGKCSRFYLCCKRIW

SEQ ID NO: 508 - protein, 36 aa, Gallus gallus
LFCKGGSCHFGGCPSHLIKVGSCFGFRSCCKWPWNA

SEQ ID NO: 509 - protein, 39 aa, Gallus gallus
GRKSDCFRKNGFCAFLKCPYLTLISGKCSRFHLCCKRIW

SEQ ID NO: 510 - protein, 65 aa, Gallus gallus
MRIVYLLLPFILLLAQGAAGSSQALGRKSDCFRKSGFCAFLKCPSLTLISGKCSRFYLCCKRIWG

SEQ ID NO: 511 - protein, 64 aa, Gallus gallus
MRILYLLFSLLFLALQVSPGLSSPRRDMLFCKGGSCHFGGCPSHLIKVGSCFGFRSCCKWPWNA

SEQ ID NO: 512 - protein, 42 aa, Sus scrofa
YAEGTFISDYSIAMDKIRQQDFVNWLLAQKGKKSDWKHNITQ

SEQ ID NO: 513 - protein, 130 aa, Hyalophora cecropia
DVTWDKNIGNGKVFGTLGQNDDGLFGKAGFKQQFFNDDRGKFEGQAYGTRVLGPAGGTTNFGGRLDWSDKNANAALDISKQIGGRPNLSASGAGVWDFDKNTRLSAGGSLSTMGRGKPDVGVHAQFQHDF

SEQ ID NO: 514 - protein, 18 aa, Acanthoscurria gomesiana
QCRRLCYKQRCVTYCRGR

SEQ ID NO: 515 - protein, 31 aa, Cavia
RRCICTTRTCRFPYRRLGTCLFQNRVYTFCC

SEQ ID NO: 516 - protein, 41 aa, Hadrurus aztecus
GILDTIKSIASKVWNSKTVQDLKRKGINWVANKLGVSPQAA

SEQ ID NO: 517 - protein, 133 aa, Pyrrhocoris apterus
DVELKGKGGENEGFVGLKAQRNLYEDDRTSLSGTVKGQSQWKDPYPAQHAGMARLDGTRTLIENDRTKVTGSGFAQREVATGMRPHDSFGVGVEATHNIYKGKNGEVDVFGGVQRQWNTPDRHQARGGIRWRF

SEQ ID NO: 518 - protein, 83 aa, Mus musculus
MALSTRTQAACLLLLLLASLSSTTYLQQQMRQTTELQPLHGEESRADIAIPMQKRRKRDINFPICRFCCQCCNKPSCGICCEE

SEQ ID NO: 519 - protein, 91 aa, Danio rerio
MKLSNVFLAAVVILTCVCVFQITAVPFIQQVQDEHHVESEELQENQHLTEAEHRLTDPLVLFRTKRQSHLSLCRFCCKCCRNKGCGYCCKF

SEQ ID NO: 520 - protein, 85 aa, Morone chrysops x Morone saxatilis
MKTFSVAVAVAVVLAFICLQESSAVPVTEVQELEEPMSNEYQEMPVESWKMPYNNRHKRHSSPGGCRFCCNCCPNMSGCGVCCRF

SEQ ID NO: 521 - protein, 83 aa, Mus musculus
MALSTRTQAACLLLLLLASLSSTTYLHQQMRQTTELQPLHGEESRADIAIPMQKRRKRDTNFPICIFCCKCCNNSQCGICCKT

SEQ ID NO: 522 - protein, 84 aa, Rattus norvegicus
MALSTRIQAACLLLLLLASLSSGAYLRQQTRQTTALQPWHGAESKTDDSALLMLKRRKRDTNFPICLFCCKCCKNSSCGLCCIT

SEQ ID NO: 523 - protein, 61 aa, Oncorhynchus mykiss
  misc_feature (37)..(37): Xaa can be any naturally occurring amino acid
  misc_feature (55)..(55): Xaa can be any naturally occurring amino acid
LQVLTEEVGSIDSPVGEHQQPGGESMRLPEHFRFKRXSHLSLCRWCCNCCHNKGXGFCCKF

SEQ ID NO: 524 - protein, 39 aa, Bufo gargarizans
AGRGKQGGKVRAKAKTRSSRAGLQFPVGRVHRLLRKGNY

SEQ ID NO: 525 - protein, 51 aa, Hippoglossus hippoglossus
SGRGKTGGKARAKAKTRSSRAGLQFPVGRVHRLLRKGNYAHRVGAGAPVYL

SEQ ID NO: 526 - protein, 20 aa, Ictalurus punctatus
  misc_feature (19)..(19): Xaa can be any naturally occurring amino acid
PDPAKTAPKKGSKKAVTKXA

SEQ ID NO: 527 - protein, 17 aa, Ictalurus punctatus
PDPAKTAPKKKSKKAVT

SEQ ID NO: 528 - protein, 43 aa, Holotrichia diomphalia
VTCDLLSLQIKGIAINDSACAAHCLAMRRKGGSCKQGVCVCRN

SEQ ID NO: 529 - protein, 127 aa, Holotrichia diomphalia
MMKLVIALCLIGISAAYVVPVYYEIYPEDATFDEADIEPQLSPAELHHGSIRERRSLQPGAPSFPMPGSQLPTSVSGNVEKQGRNTIATIDAQHKTDRYDVRGTWTKVVDGPGRSKPNFRIGGSYRW

SEQ ID NO: 530 - protein, 127 aa, Holotrichia diomphalia
MMKLVIALCLIGISAAYVVPVYYEIYPEDATFDEADIEPQLSPAELHHGSIRERRSLQPGAPSLSQLPTSVSGNVEKQGRPMPGNTIATIDAQHKTDRYDVRGTVDGPGRSKPNFRIGGSWTKVYRW

SEQ ID NO: 531 - protein, 104 aa, Holotrichia diomphalia
MNKLIILGLACIIAVASAMPYGPGDGHGGGHGGGHGGGHGNGQGGGHGHGPGGGFGGGHGGGHGGGGRGGGGSGGGGSPGHGAGGGYPGGHGGGHHGGYQTHGY

SEQ ID NO: 532 - protein, 129 aa, Apis mellifera
MKFIVLVLFCAVAYVSAQAELEPEDTMDYIPTRFRRQERGSIVIQGTKEGKSRPSLDIDYKQRVYDKNGMTGDAYGGLNIRPGQPSRQHAGFEFGKEYKNGFIKGQSEVQRGPGGRLSPYFGINGGFRF

SEQ ID NO: 533 - protein, 14 aa, Bos taurus
  misc_feature (14)..(14): Xaa can be any naturally occurring amino acid
ILPWKWPWWPWRRX

SEQ ID NO: 534 - protein, 144 aa, Bos taurus
MQTQRASLSLGRWSLWLLLLGLVVPSASAQALSYREAVLRAVDQLNELSSEANLYRLLELDPPPKDNEDLGTRKPVSFTVKETVCPRTIQQPAEQCDFKEKGRVKQCVGTVTLDPSNDQFDLNCNELQSVILPWKWPWWPWRRG

SEQ ID NO: 535 - protein, 40 aa, Protophormia terraenovae
ATCDLLSGTGINHSACAAHCLLRGNRGGYCNGKGVCVCRN

SEQ ID NO: 536 - protein, 15 aa, Mus sp.
SETAPAETPAPAKAE

SEQ ID NO: 537 - protein, 14 aa, Rana japonica
FFPIGVFCKIFKTC

SEQ ID NO: 538 - protein, 21 aa, Rana japonica
FGLPMLSILPKALCILLKRKC

SEQ ID NO: 539 - protein, 25 aa, Bos taurus
FKCRRWQWRMKKLGAPSITCVRRAF

SEQ ID NO: 540 - protein, 703 aa, Sus scrofa
MKLFIPALLFLGTLGLCLAAPKKGVRWCVISTAEYSKCRQWQSKIRRTNPMFCIRRASPTDCIRAIAAKRADAVTLDGGLVFEADQYKLRPVAAEIYGTEENPQTYYYAVAVVKKGFNFQNQLQGRKSCHTGLGRSAGWNIPIGLLRRFLDWAGPPEPLQKAVAKFFSQSCVPCADGNAYPNLCQLCIGKGKDKCACSSQEPYFGYSGAFNCLHKGIGDVAFVKESTVFENLPQKADRDKYELLCPDNTRKPVEAFRECHLARVPSHAVVARSVNGKENSIWELLYQSQKKFGKSNPQEFQLFGSPGQQKDLLFRDATIGFLKIPSKIDSKLYLGLPYLTAIQGLRETAAEVEARQAKVVWCAVGPEELRKCRQWSSQSSQNLNCSLASTTEDCIVQVLKGEADAMSLDGGFIYTAGKCGLVPVLAENQKSRQSSSSDCVHRPTQGYFAVAVVRKANGGITWNSVRGTKSCHTAVDRTAGWNIPMGLLVNQTGSCKFDEFFSQSCAPGSQPGSNLCALCVGNDQGVDKCVPNSNERYYGYTGAFRCLAENAGDVAFVKDVTVLDNTNGQNTEEWARELRSDDFELLCLDGTRKPVTEAQNCHLAVAPSHAVVSRKEKAAQVEQVLLTEQAQFGRYGKDCPDKFCLFRSETKNLLFNDNTECLAQLQGKTTYEKYLGSEYVTAIANLKQCSVSPLLEACAFMMR

SEQ ID NO: 541 - protein, 708 aa, Bos taurus
MKLFVPALLSLGALGLCLAAPRKNVRWCTISQPEWFKCRRWQWRMKKLGAPSITCVRRAFALECIRAIAEKKADAVTLDGGMVFEAGRDPYKLRPVAAEIYGTKESPQTHYYAVAVVKKGSNFQLDQLQGRKSCHTGLGRSAGWIIPMGILRPYLSWTESLEPLQGAVAKFFSASCVPCIDRQAYPNLCQLCKGEGENQCACSSREPYFGYSGAFKCLQDGAGDVAFVKETTVFENLPEKADRDQYELLCLNNSRAPVDAFKECHLAQVPSHAVVARSVDGKEDLIWKLLSKAQEKFGKNKSRSFQLFGSPPGQRDLLFKDSALGFLRIPSKVDSALYLGSRYLTTLKNLRETAEEVKARYTRVVWCAVGPEEQKKCQQWSQQSGQNVTCATASTTDDCIVLVLKGEADALNLDGGYIYTAGKCGLVPVLAENRKSSKHSSLDCVLRPTEGYLAVAVVKKANEGLTWNSLKDKKSCHTAVDRTAGWNIPMGLIVNQTGSCAFDEFFSQSCAPGADPKSRLCALCAGDDQGLDKCVPNSKEKYYGYTGAFRCLAEDVGDVAFVKNDTVWENTNGESTADWAKNLNREDFRLLCLDGTRKPVTEAQSCHLAVAPNHAVVSRSDRAAHVKQVLLHQQALFGKNGKNCPDKFCLFKSETKNLLFNDNTECLAKLGGRPTYEEYLGTEYVTAIANLKKCSTSPLLEACAFLTR

SEQ ID NO: 542 - protein, 179 aa, Bombyx mori
MYKFLVFSSVLVLFFAQASCQRFIQPTFRPPPTQRPIIRTARQAGQEPLWLYQGDNVPRAPSTADHPILPSKIDDVQLDPNRRYVRSVTNPENNEASIEHSHHTVDTGLDQPIESHRNTRDLRFLYPRGKLPVPTPPPFNPKPIYIDMGNRYRRHASDDQEELRQYNEHFLIPRDIFQE

SEQ ID NO: 543 - protein, 179 aa, Bombyx mori
MYKFLVFSSVLVLFFAQASCQRFIQPTFRPPPTQRPITRTVRQAGQEPLWLYQGDNVPRAPSTADHPILPSKIDDVQLDPNRRYVRSVTNPENNEASIEHSHHTVDIGLDQPIESHRNTRDLRFLYPRGKLPVPTLPPFNPKPIYIDMGNRYRRHASEDQEELRQYNEHFLIPRDIFQE

SEQ ID NO: 544 - protein, 221 aa, Limulus polyphemus
VQWHQIPGKLMHITATPHFLWGVNSNQQIYLCRQPCYDGQWTQISGSLKQVDADDHEVWGVNRNDDIYKRPVDGSGSWVRVSGKLKHVSASGYGYIWGVNSNDQIYKCPKPCNGAWTQVNGRLKQIDGGQSMVYGVNSANAIYRRPVDGSGSWQQISGSLKHITGSGLSEVFGVNSNDQIYRCTKPCSGQWSLIDGRLKQCDATGNTIVGVNSVDNIYRSG

SEQ ID NO: 545 - protein, 394 aa, Tachypleus tridentatus
MKVLLLVAFLLGTTLAYPQDDDGPVWGGSSNDNDDGGISSRVGNPQSGFGNCECVPYYLCKDNNIIIDGSGLLDPRKKPVASKEPKLSARLGPEGPSGCGPFHVCCIAPETSTVKPYTHQCGFRNVNGINKRILSPNGKDLSEFGEWPWQGAVLKVEGKVNIFQCGAVLIDSYHLLTVAHCVYKFTLENAFPLKVRLGEWDTQNTNEFLKHEDYEVEKIYIHPKYDDERKNLWDDIAILKLKAEVSFGPHIDTICLPNNQEHFAGVQCVVTGWGKNAYKNGSYSNVLREVHVPVITNDRCQELLRKTRLSEWYVLYENFICAGGESNADSCKGDGGGPLTCWRKDGTYGLAGLVSWGINCGSPNVPGVYVRVSNYLDWITKITGRPISDYWPRS

SEQ ID NO: 546 - protein, 64 aa, Bos taurus
MRLHHLLLALLFLVLSAGSGFTQGVRNSQSCRRNKGICVPIRCPGSMRQIGTCLGAQVKCCRRK

SEQ ID NO: 547 - protein, 77 aa, Bos taurus
MWHLKLFAVLMICLLLLAQVDGSPIPQQSSAKRRPRRMTPFWRAVSLRPIGASCRDDSECITRLCRKRRCSLSVAQE

SEQ ID NO: 548 - protein, 77 aa, Macaca mulatta
MWHLKLCAVLMIFLLLLGQTDGSPIPEVSSAKRRPRRMTPFWRGVSLRPIGASCRDDSECITRLCRKRRCSLSVAQE

SEQ ID NO: 549 - protein, 76 aa, Mus musculus
MLQLKLFAVLLTCLLLLGQVNSSPVPEVSSAKRSRRMTPFWRGVSLRPIGASCRDDSECITRLCRKRRCSLSVAQE

SEQ ID NO: 550 - protein, 77 aa, Sus scrofa
MWHLKLFAVLVICLLLAVQVHGSPIPELSSAKRRPRRMTPFWRAVSLRPIGASCRDDSECLTRLCRKRRCSLSVAQE

SEQ ID NO: 551 - protein, 71 aa, Cavia porcellus
SVVLLICLLLLGQVDGSPVPEKSSVKKRLRRMTPFWRGVSLRPIGASCRDDSECITRLCKKRRCSLSVAQE

SEQ ID NO: 552 - protein, 77 aa, Sus scrofa
MWHLKLFAVLVICLLLAVQVHGSPIPELSSAKRRPRRITPFWRAVSLRPIGASCRDDSECLTRLCRKRRCSLSVAQE

SEQ ID NO: 553 - protein, 141 aa, Heliothis virescens
MQKLTLFVVALAAVVLHCEAKQFSRCGLVQELRRQGFPEDKLGDWVCLVENESARKTDKVGTVNKNGSRDYGLYQINDKYWCSNTSTPGKDCNVTCAEMLLDDITKASTCAKKIYKRHKFEAWYGWKNHCKGKTLPDISNC

SEQ ID NO: 554 - protein, 129 aa, Alopochen aegyptiaca
KVYGRCELAAAMKRLGLDNYRGYSLGNWVCAAKYESGFNTQATNRNTDGSTDYGILQINSRWWCNDGKTPRAKNVCGIPCSVLLRSDITEAVKCAKRIVSDGNGMNAWVAWRNRCKGTDVSQWIRGCRL

SEQ ID NO: 555 - protein, 129 aa, Chrysolophus pictus
KVYGRCELAAAMKRLGLDNYRGYSLGNWVCAAKFESNFNTHATNRNTDGSTDYGILQINSRWWCNDGRTPGSRNLCHIPCSALLSSDITASVNCAKKIVSDGNGMNAWVAWRNRCKGTDVNAWTRGCRL

SEQ ID NO: 556 - protein, 129 aa, Lophophorus impejanus
KVYGRCELAAAMKRLGLDNYRGYSLGNWVCAAKFESNFNTHATNRNTDGSTDYGILQINSRWWCNDGRTPGSRNLCNIPCSALLSSDITASVNCAKKIVSDGNGMNAWVAWRNRCKGTDVHAWIRGCRL

SEQ ID NO: 557 - protein, 120 aa, Manduca sexta
KHFSRCELVHELRRQGFPENLMRDWVCLVENESSRYTDKVGRVNKNGSRDYGLFQINDKYWCSNGSTPGKDCNVKCSDLLIDDITKASTCAKKIYKRHKFQAWYGWRNHCQGSLPDISSC

SEQ ID NO: 558 - protein, 129 aa, Ovis aries
KVFERCELARTLKELGLDGYKGVSLANWLCLTKWESSYNTKATNYNPGSESTDYGIFQINSKWWCNDGKTPNAVDGCHVSCSELMENNIAKAVACAKHIVSEQGITAWVAWKSHCRDHDVSSYVEGCSL

SEQ ID NO: 559 - protein, 148 aa, Rattus norvegicus
MKALLVLGFLLLSASVQAKIYERCEFARTLKRNGMSGYYGVSLADWVCLAQHESNYNTQARNYNPGDQSTDYGIFQINSRYWCNDGKTPRAKNACGIPCSALLQDDITQAIQCAKRVVRDPQGIRAWVAWQRHCKNRDLSGYIRNCGV

SEQ ID NO: 560 - protein, 129 aa, Bos taurus
KTFKRCELARTLKNLGLAGYKGVSLANWMCLAKGESNYNTQAKNYNPGSKSTDYGIFQINSKWWCNDGKTPKAVNGCGVSCSALLKDDITQAVACAKKIVSQQGITAWVAWKNKCRNRDLTSYVKGCGV

SEQ ID NO: 561 - protein, 129 aa, Cervus axis
KVFERCELARTLKELGLDGYKGVSLANWLCLTKWESSYNTKATNYNPGSESTDYGIFQINSKWWCNDGKTPNAVDGCHVACSELMENDIAKAVACAKQIVREQGITAWVAWKSHCRDHDVSSYVEGCTL

SEQ ID NO: 562 - protein, 129 aa, Ovis aries
KVFERCELARTLKELGLDGYKGVSLANWLCLTKWESSYNTKATNYNPGSESTDYGIFQINSKWWCNDGKTPNAVDGCHVSCSALMENDIEKAVACAKHIVSEQGITAWVAWKSHCRDHDVSSYVEGCTL

SEQ ID NO: 563 - protein, 129 aa, Ovis aries
KVFERCELARTLKKLGLDDYKGVSLANWLCLTKWESGYNTKATNYNPGSESTDYGIFQINSKWWCNDGKTPNAVDGCHVSCSALMENDIEKAVACAKHIVSEQGITAWVAWKSHCRDHDVSSYVEGCTL

SEQ ID NO: 564 - protein, 130 aa, Bos taurus
KVFERCELARSLKRFGMDNFRGISLANWMCLARWESNYNTQATNYNAGDQSTDYGIFQINSHWWCNDGKTPGAVNACHLPCGALLQDDITQAVACAKRVVSDPQGIRAWVAWRSHCQNQDLTSYIQGCGV

SEQ ID NO: 565 - protein, 140 aa, Drosophila melanogaster
MKAFIVLVALASGAPALGRTMDRCSLAREMSNLGVPRDQLARWACIAEHESSYRTGVVGPENYNGSNDYGIFQINDYYWCAPPSGRFSYNECGLSCNALLTDDITHSVRCAQKVLSQQGWSAWSTWHYCSGWLPSIDDCF

SEQ ID NO: 566 - protein, 130 aa, Papio sp.
KIFERCELARTLKRLGLDGYRGISLANWVCLAKWESDYNTQATNYNPGDQSTDYGIFQINSHYWCNDGKTPGAVNACHISCNALLQDNITDAVACAKRVVSDPQGIRAWVAWRNHCQNRDVSQYVQGCGV

SEQ ID NO: 567 - protein, 129 aa, Numida meleagris
KVFGRCELAAAMKRHGLDNYRGYSLGNWVCAAKFESNFNSQATNRNTDGSTDYGVLQINSRWWCNDGRTPGSRNLCNIPCSALQSSDITATANCAKKIVSDGDGMNAWVAWRKHCKGTDVRVWIKGCRL

SEQ ID NO: 568 - protein, 129 aa, Coturnix japonica
KVYGRCELAAAMKRHGLDKYQGYSLGNWVCAAKFESNFNTQATNRNTDGSTDYGILQINSRWWCNDGRTPGSRNLCNIPCSALLSSDITASVNCAKKIVSDVHGMNAWVAWRNRCKGTDVNVWIRGCRL

SEQ ID NO: 569 - protein, 132 aa, Hyalophora cecropia
CRSWQFALHCDAKRFTRCGLVQELRRRGFDETLMSNWVCLVENESGRFTDKIGKVNKNGSRDYGLFQINDKYWCSKGSTPGKDCNVTCNQLLTDDISVAATCAKKIYKRHKFDAWYGWKNHCQHGLPDISDC

SEQ ID NO: 570 - protein, 147 aa, Phasianus colchicus
MRSLLILVLCFLPLAAPGKVYGRCELAAAMKRMGLDNYRGYSLGNWVCAAKFESNFNTGATNRNTDGSTDYGILQINSRWWCNDGRTPGSKNLCHIPCSALLSSDITASVNCAKKIVSDGDGMNAWVAWRKHCKGTDVNVWIRGCRL

SEQ ID NO: 571 - protein, 140 aa, Drosophila melanogaster
MKAFIVLVALALAAPALGRTLDRCSLAREMSNLGVPRDQLARWACIAEHESSYRTGVVGPENYNGSNDYGIFQINDYYWCAPPSGRFSYNECGLSCNALLTDDITHSVRCAQKVLSQQGWSAWSTWHYCSGWLPSIDDCF

SEQ ID NO: 572 - protein, 185 aa, Rhea americana
RTNCYGDVSRIDTTGASCKTAKPEKLNYCGVAASRKIAERDLRSMDRYKTLIKKVGQKLCVEPAVIAGIISRESHAGKALKNGWGDNGNGFGLMQVDRRSHKPVGEWNGERHLIQGTEILISMIKAMQRKFPRWTKEQQLKGGISAYNAGPGNVRTYERMDIGTTHDDYANDVVARAQYYKQHGY

SEQ ID NO: 573 - protein, 185 aa, Casuarius casuarius
QTGCYGVVNRIDTTGASCETAKPEKLNYCGVAASRKIAEGDLQSMDRYKTLIKKVGQKLCVDPAVIAGIISRESHAGKALKDGWGDNGNGFGLMQVDKRSHTPVGKWNGERHLTQGTEILISMIKKIQKKFPRWTKEQQLKGGISAYNAGSGNVRTYERMDIGTTHNDYANDVVARAQYYKQHGY

SEQ ID NO: 574 - protein, 140 aa, Drosophila melanogaster
MKAFIVLVALACAAPAFGRTMDRCSLAREMSNLGVPRDQLNKWACIAEHESSYRTGVVGPENYNGSNDYGIFQINDYYWCAPPSGRFSYNECGLSCNALLTDDITHSVRCAQKVLSQQGWSAWSTWHYCSGWLPSIDDCF

SEQ ID NO: 575 - protein, 145 aa, Opisthocomus hoazin
MLFFGFLLAFLSAVPGTEGEIISRCELVKILREHGFEGFEGTTIADWICLVQHESDYNTEAYNNNGPSRDYGIFQINSKYWCNDGKTSGAVDGCHISCSELMTNDLEDDIKCAKKIARDAHGLTPWYGWKNHCEGRDLSSYVKGC

SEQ ID NO: 576 - protein, 139 aa, Drosophila melanogaster
MKAFFALVLLPLPLCLAGRTLDRCSLAREMADLGVPRDQLDKWTCIAQHESDYRTWVVGPANSDGSNDYGIFQINDLYWCQADGRFSYNECGLSCNALLTDDITNSVRCAQKVLSQQGWSAWAVWHYCSGWLPSIDECF

SEQ ID NO: 577 - protein, 81 aa, Drosophila melanogaster
PNTDGSNDYGIFQINDLYWCQPSSGKFSHNGCDVSCNALLTDDIKSSVRCALKVLGQQGWSAWSTWHYCSGYLPPIDDCFV

SEQ ID NO: 578 - protein, 140 aa, Drosophila melanogaster
MKAFIVLVALACAAPAFGRTMDRCSLAREMSNLGVPRDQLARWACIAEHESSYRTGVVGPENYNGSNDYGIFQINDYYWCAPPSGRFSYNECGLSCNALLTDDITHSVRCAQKVLSQQGWSAWSTWHYCSGWLPSIDDCF

SEQ ID NO: 579 - protein, 129 aa, Callipepla californica
KVFGRCELAAAMKRHGLDNYRGYSLGNWVCAAKFESNFNSQATNRNTDGSTDYGVLQINSRWWCNDGRTPGSRNLCNIPCSALLSSDITATVNCAKKIVSDGNGMNAWVAWRNRCKGTDVHAWIRGCRL

SEQ ID NO: 580 - protein, 130 aa, Colinus virginianus
MKVFGRCELAAAMKRHGLDNYRGYSLGNWVCAAKFESNFNSQATNRNTDGSTDYGVLQINSRWWCNDGKTPGSRNLCNIPCSALLSSDITATVNCAKKIVSDGNGMNAWVAWRNRCKGTDVQAWIRGCRL

SEQ ID NO: 581 - protein, 127 aa, Columba livia
KDIPRCELVKILRRHGFEGFVGKTVANWVCLVKHESGYRTTAFNNNGPNSRDYGIFQINSKYWCNDGKTRGSKNACNINCSKLRDDNIADDIQCAKKIAREARGLTPWVAWKKYCQGKDLSSYVRGC

SEQ ID NO: 582 - protein, 129 aa, Equus asinus
KVFSKCELAHKLKAQEMDGFGGYSLANWVCMAEYESNFNTRAFNGKNANGSYDYGLFQLNSKWWCKDNKRSSSNACNIMCSKLLDDNIDDDISCAKRVVRDPKGMSAWKAWVKHCKDKDLSEYLASCNL

SEQ ID NO: 583 - protein, 129 aa, Ortalis vetula
KIYKRCELAAAMKRYGLDNYRGYSLGNWVCAARYESNYNTQATNRNSNGSTDYGILQINSRWWCNDGRTPGTKNLCHISCSALMGADIAPSVRCAKRIVSDGDGMNAWVAWRKHCKGTDVSTWIKDCKL

SEQ ID NO: 584 - protein, 130 aa, Oryctolagus cuniculus
KIYERCELARTLKKLGLDGYKGVSLANWMCLAKWESSYNTRATNYNPGDKSTDYGIFQINSRYWCNDGKTPRAVNACHIPCSDLLKDDITQAVACAKRVVSDPQGIRAWVAWRNHCQNQDLTPYIRGCGV

SEQ ID NO: 585 - protein, 129 aa, Syrmaticus soemmerringii
KVYGRCELAAAMKRLGLDNFRGYSLGNWVCAAKFESNFNTHATNRNTDGSTDYGILQINSRWWCNDGRTPGSRNLCNIPCSALLSSDTIASVNCAKKIVSDGNGMNAWVAWRKRCKGTDVNAWTRGCRL

SEQ ID NO: 586 - protein, 20 aa, Felis catus
KIFTKCELARKLRAEGMDGF

SEQ ID NO: 587 - protein, 49 aa, Pseudocheirus peregrinus
SKMKKCEFAKIAKEQHMDGYHGVSLADWVCLVNNESDFNTKAINRNKGI

SEQ ID NO: 588 - protein, 129 aa, Lophura leucomelanos
KVYGRCELAAAMKRLGLDNYRGYSLGNWVCAAKYESNFNTHATNRNTDGSTDYGILQINSRWWCNDGKTPGSRNLCHIPCSALLSSDITASVNCAKKIVSDGNGMNAWVAWRNRCKGTDVSVWTRGCRL

SEQ ID NO: 589 - protein, 129 aa, Pavo cristatus
KVYGRCELAAAMKRLGLDNYRGYSLGNWVCAAKFESNFNTHATNRNTDGSTDYGILQINSRWWCNDGRTPGSRNLCNIPCSALLSSDITASVNCAKKIVSDRNGMNAWVAWRNRCKGTDVHAWIRGCRL

SEQ ID NO: 590 - protein, 130 aa, Phasianus versicolor
GKVYGRCELAAAMKRMGLDNYRGYSLGNWVCAAKFESNFNTGATNRNTDGSTDYGILQINSRWWCNDGRTPGSKNLCHIPCSALLSSDITASVNCAKKIVSDGDGMNAWVAWRKHCKGTDVNVWIRGCRL

SEQ ID NO: 591 - protein, 129 aa, Syrmaticus reevesi
KVYGRCELAAAMKRLGLDNYRGYSLGNWVCAAKFESNFNTHATNRNTDGSTDYGILQINSRWWCNDGRTPGSRNLCHISCSALLSSDITASVNCAKKIVSDRNGMNAWVAWRNRCKGTDVNAWIRGCRL

SEQ ID NO: 592 - protein, 129 aa, Cervus axis
KVFERCELARTLKELGLDGYKGVSLANWLCLTKWESSYNTKATNYNPGSESTDYGIFQINSKWWCDDGKTPNAVDGCHVACSELMENNIDKAVTCAKQIVREQGITAWVAWKSHCRGHDVSSYVEGCTL

SEQ ID NO: 593 - protein, 147 aa, Bos taurus
MKALIILGFLFLSVAVQGKVFERCELARTLKKLGLDGYKGVSLANWLCLTKWESSYNTKATNYNPGSESTDYGIFQINSKWWCNDGKTPNAVDGCHVSCSELMENDIAKAVACAKQIVSEQGITAWVAWKSHCRDHDVSSYVEGCTL

SEQ ID NO: 594 - protein, 147 aa, Bos taurus
MKALVILGFLFLSVAVQGKVFERCELARTLKKLGLDGYKGVSLANWLCLTKWESSYNTKATNYNPSSESTDYGIFQINSKWWCNDGKTPNAVDGCHVSCSELMENDIAKAVACAKHIVSEQGITAWVAWKSHCRDHDVSSYVEGCTL

SEQ ID NO: 595 - protein, 147 aa, Bos taurus
MKALIILGFLFLSVAVQGKVFERCELARTLKKLGLDGYKGVSLANWLCLTKWESSYNTKATNYNPSSESTDYGIFQINSKWWCNDGKTPNAVDGCHVSCSELMENDIAKAVACAKHIVSEQGITAWVAWKSHCRDHDVSSYVQGCTL

SEQ ID NO: 596 - protein, 125 aa, Tachyglossus aculeatus
KILKKQELCKNLVAQGMNGYQHITLPNWVCTAFHESSYNTRATNHNTDGSTDYGILQINSRYWCHDGKTPGSKNACNISCSKLLDDDITDDLKCAKKIAGEAKGLTPWVAWKSKCRGHDLSKFKC

SEQ ID NO: 597 - protein, 144 aa, Oncorhynchus mykiss
MRAVVVLLLVAVASAKVYDRCELARALKASGMDGYAGNSLPNWVCLSKWESSYNTQATNRNTDGSTDYGIFQINSRYWCDDGRTPGAKNVCGIRCSQLLTADLTVAIRCAKRVVLDPNGIGAWVAWRLHCQNQDLRSYVAGCGV

SEQ ID NO: 598 - protein, 147 aa, Coturnix japonica
MRSLLVLVLCFLPLAALGKVYGRCELAAAMKRHGLDKYQGYSLGNWVCAAKFESNFNTQATNRNTDGSTDYGILQINSRWWCNDGRTPGSRNLCNIPCSALLSSDITASVNCAKKIVSDVHGMNAWVAWRNRCKGTDVNAWIRGCRL

SEQ ID NO: 599 - protein, 147 aa, Meleagris gallopavo
MRSLLILVLCFLPLAALGKVYGRCELAAAMKRLGLDNYRGYSLGNWVCAAKFESNFNTHATNRNTDGSTDYGILQINSRWWCNDGRTPGSKNLCNIPCSALLSSDITASVNCAKKIASGGNGMNAWVAWRNRCKGTDVHAWIRGCRL

SEQ ID NO: 600 - protein, 148 aa, Presbytis entellus
MKALTILGLVLLSVTVQGKIFERCELARTLKKLGLDGYKGVSLANWVCLAKWESGYNTEATNYNPGDESTDYGIFQINSRYWCNNGKTPGAVDACHISCSALLQNNIADAVACAKRVVSDPQGIRAWVAWRNHCQNKDVSQYVKGCGV

SEQ ID NO: 601 - protein, 147 aa, Gallus gallus
MRSLLILVLCFLPLAALGKVFGRCELAAAMKRHGLDNYRGYSLGNWVCAAKFESNFNTQATNRNTDGSTDYGILQINSRWWCNDGRTPGSRNLCNIPCSALLSSDITASVNCAKKIVSDGNGMNAWVAWRNRCKGTDVQAWIRGCRL

SEQ ID NO: 602 - protein, 148 aa, Rattus norvegicus
MKALLVLGFLLLSASVQAKVFKHCELARILRSSALAGYRGVSLENWMCMAQHESNFDTEAINYNSTDQSTDYGIFQINSRYWCNDGKTPRAVNACGIPCSALLQDDITQAIQCAKRVVRDPQGIRAWVAWQRHCQNRDLSGYIRNCGV

SEQ ID NO: 603 - protein, 148 aa, Mus musculus
MKTLLTLGLLLLSVTAQAKVYERCEFARTLKRNGMAGYYGVSLADWVCLAQHESNYNTRATNYNRGDQSTDYGIFQINSRYWCNDGKTPRAVNACGINCSALLQDDITAAIQCAKRVVRDPQGIRAWVAWRAHCQNRDLSQYIRNCGV

SEQ ID NO: 604 - protein, 148 aa, Mus musculus
MKALLTLGLLLLSVTAQAKVYNRCELARILKRNGMDGYRGVKLADWVCLAQHESNYNTRATNYNRGDRSTDYGIFQINSRYWCNDGKTPRSKNACGINCSALLQDDITAAIQCAKRVVRDPQGIRAWVAWRTQCQNRDLSQYIRNCGV

SEQ ID NO: 605 - protein, 147 aa, Anas platyrhynchos
MKALLTLVFCLLPLAAQGKVYSRCELAAAMKRLGLDNYRGYSLGNWVCAANYESGFNTQATNRNTDGSTDYGILQINSRWWCDNGKTPRSKNACGIPCSVLLRSDITEAVRCAKRIVSDGDGMNAWVAWRNRCRGTDVSKWIRGCRL

SEQ ID NO: 606 - protein, 129 aa, Anas platyrhynchos
KVYERCELAAAMKRLGLDNYRGYSLGNWVCAANYESSFNTQATNRNTDGSTDYGILEINSRWWCDNGKTPRAKNACGIPCSVLLRSDITEAVKCAKRIVSDGDGMNAWVAWRNRCKGTDVSRWIRGCRL

SEQ ID NO: 607 - protein, 185 aa, Anser anser [sequence omitted]

SEQ ID NO: 608 - protein, 185 aa, Cygnus atratus
RTDCYGNVNRIDTTGASCKTAKPEGLSYCGVPASKTIAERDLKAMDRYKTIIKKVGEKLCVEPAVIAGIISRESHAGKVLKNGWGDRGNGFGLMQVDKRSHKPQGTWNGEVHITQGTTILTDFIKRIQKKFPSWTKDQQLKGGISAYNAGAGNVRSYARMDIGTTHDDYANDVVARAQYYKQHGY

SEQ ID NO: 609 - protein, 185 aa, Struthio camelus
RTGCYGDVNRVDTTGASCKSAKPEKLNYCGVAASRKIAERDLQSMDRYKALIKKVGQKLCVDPAVIAGIISRESHAGKALRNGWGDNGNGFGLMQVDRRSHKPVGEWNGERHLMQGTEILISMIKAIQKKFPRWTKEQQLKGGISAYNAGPGNVRSYERMDIGTTHDDYANDVVARAQYYKQHGY

SEQ ID NO: 610 - protein, 211 aa, Gallus gallus
MLGKNDPMCLVLVLLGLTALLGICQGGTGCYGSVSRIDTTGASCRTAKPEGLSYCGVRASRTIAERDLGSMNKYKVLIKRVGEALCIEPAVIAGIISRESHAGKILKNGWGDRGNGFGLMQVDKRYHKIEGTWNGEAHIRQGTRILIDMVKKIQRKFPRWTRDQQLKGGISAYNAGVGNVRSYERMDIGTLHDDYSNDVVARAQYFKQHGY

SEQ ID NO: 611 - protein, 141 aa, Drosophila melanogaster
MKAFLVICALTLTAVATQARTMDRCSLAREMSKLGVPRDQLAKWTCIAQHESSFRTGVVGPANSNGSNDYGIFQINNKYWCKPADGRFSYNECGLSCNALLTDDITNSVKCARKIQRQQGWTAWSTWKYCSGSLPSINSCF

SEQ ID NO: 612 - protein, 137 aa, Chlamys islandica
MMYFVLLCLLATGTTYGAHNFATGIVPQSCLECICKTESGCRAIGCKFDVYSDSCGYFQLKQAYWEDCGRPGGSLTSCADDIHCSSQCVQHYMSRYIGHTSCSRTCESYARLHNGGPHGCEHGSTLGYWGHVQGHGC

SEQ ID NO: 613 - protein, 137 aa, Bombyx mori
MQKLIIFALVVLCVGSEAKTFTRCGLVHELRKHGFEENLMRNWVCLVEHESSRDTSKTNTNRNGSKDYGLFQINDRYWCSKGASPGKDCNVKCSDLLTDDITKAAKCAKKIYKRHRFDAWYGWKNHCQGSLPDISSC

SEQ ID NO: 614 - protein, 139 aa, Hyalophora cecropia
MTKYVILLAVLAFALHCDAKRFTRCGLVQELRRLGFDETLMSNWVCLVENESGRFTDKIGKVNKNGSRDYGLFQINDKYWCSKGTTPGKDCNVTCNQLLTDDISVAATCAKKIYKRHKFDAWYGWKNHCQHGLPDISDC

SEQ ID NO: 615 - protein, 21 aa, Litoria genimaculata
GLFGVLAKVAAHVVPAIAEHF

SEQ ID NO: 616 - protein, 23 aa, Litoria genimaculata
GLFGVLAKVASHVVPAIAEHFQA

SEQ ID NO: 617 - protein, 18 aa, Litoria genimaculata
GFVDFLKKVAGTIANVVT

SEQ ID NO: 618 - protein, 26 aa, Litoria genimaculata
GLLQTIKEKLESLESLAKGIVSGIQA

SEQ ID NO: 619 - protein, 303 aa, Xenopus laevis
MFKGLFICSLIAVICANALPQPEASADEDMDEREVRGIGKFLHSAGKFGKAFVGEIMKSKRDAEAVGPEAFADEDLDEREVRGIGKFLHSAKKFGKAFVGEIMNSKRDAEAVGPEAFADEDLDEREVRGIGKFLHSAKKFGKAFVGEIMNSKRDAEAVGPEAFADEDLDEREVRGIGKFLHSAKKFGKAFVGEIMNSKRDAEAVGPEAFADEDFDEREVRGIGKFLHSAKKFGKAFVGEIMNSKRDAEAVGPEAFADEDLDEREVRGIGKFLHSAKKFGKAFVGEIMNSKRDAEAVDDRRWVE

SEQ ID NO: 620 - protein, 22 aa, Rana temporaria
FIGSALKVLAGVLPSIVSWVKQ

SEQ ID NO: 621 - protein, 52 aa, Drosophila melanogaster
MQLNLGAIFLALLGVMATTTSVLAEPHRRQGPIFDTRPSPFNPNQPRPGPIY

SEQ ID NO: 622 - protein, 52 aa, Drosophila melanogaster
MQLNLGAIFLALLGVMATATSVLAEPHRHQGPIFDTRPSPFNPNQPRPGPIY

SEQ ID NO: 623 - protein, 57 aa, Mytilus galloprovincialis
CPNNYQCHRHCKSIPGRCGGYCGGWHRLRCTCYRCGGRREDVEDIFDIFDNEAADRF

SEQ ID NO: 624 - protein, 21 aa, Misgurnus anguillicaudatus
RQRVEELSKFSKKGAAARRRK

SEQ ID NO: 625 - protein, 66 aa, Bombyx mori
MNILKFFFVFIVAMSLVSCSTAAPAKIPIKAIKTVGKAVGKGLRAINIASTANDVFNFLKPKKRKH

SEQ ID NO: 626 - protein, 66 aa, Bombyx mori
MNILKLFFVFIVAMSLVSCSTAAPAKIPIKAIKTVGKAVGKGLRAINIASTANDVFNFLKPKKRKH

SEQ ID NO: 627 - protein, 160 aa, Ovis aries
METQRASLSLGRRSLWLLLLGLVLASARAQALSYREAVLRAVDQLNEKSSEANLYRLLELDPPPKQDDENSNIPKPVSFRVKETVCPRTSQQPAEQCDFKENGLLKECVGTVTLDQVGNNFDITCAEPQSVRGLRRLGRKIAHGVKKYGPTVLRIIRIAG

SEQ ID NO: 628 - protein, 165 aa, Ovis aries
METQRAGLSLGRWSLRLLLLGLVLPSASTRSFSYREAVLRAVDQFNERSAEANLYRLLELDPPPEQDAEDRGARKPVSFKVKETVCPRTSQQPVEQCDFRKNGLVKQCVGTVTRYWIRGDFDITCKDIQNVGLFGRLRDSLQRGGQKILEKAERIGDRIKDIFRG

SEQ ID NO: 629 - protein, 96 aa, Mytilus galloprovincialis
MKATILLAVLVAVFVAGTEAHSHACTSYWCGKFCGTASCTHYLCRVLHPGKMCACVHCSRVNNPFRVNQVAKSINDLDYTPIMKSMENLDNGMDML

SEQ ID NO: 630 - protein, 96 aa, Mytilus galloprovincialis
MKATMLLAVVVAVFVAGTEAHPHVCTSYYCSKFCGTAGCTRYGCRNLHRGKLCFCLHCSRVKFPFGATQDAKSMNELEYTPIMKSMENLDNGMDML

SEQ ID NO: 631 - protein, 34 aa, Mytilus edulis
GCASRCKAKCAGRRCKGWASASFRGRCYCKCFRC

SEQ ID NO: 632 - protein, 34 aa, Mytilus edulis
SCASRCKGHCRARRCGYYVSVLYRGRCYCKCLRC

SEQ ID NO: 633 - protein, 103 aa, Mytilus galloprovincialis
MKAAVILAIALVAILAVHEAEASCASRCKGHCRARRCGYYVSVLYRGRCYCKCLRCSSEHSMKFPENEGSSPSDMMPQMNENENTEFGQDMPTGETEQGETGI

SEQ ID NO: 634 - protein, 33 aa, Mytilus edulis
DCCRKPFRKHCWDCTAGTPYYGYSTRNIFGCTC

SEQ ID NO: 635 - protein, 94 aa, Rattus norvegicus
MRTLTLLTALLLLALHTQAKSPQGTAEEAPDQEQLVMEDQDISISFGGDKGTALQDADVKAGVTCYCRRTRCGFRERLSGACGYRGRIYRLCCR

SEQ ID NO: 636 - protein, 94 aa, Rattus norvegicus
MRTLTLLTALLLLALHTQAKSPQGTAEEAPDQEQLVMEDQDISISFGGDKGTALQDADVKAGVTCYCRSTRCGFRERLSGACGYRGRIYRLCCR

SEQ ID NO: 637 - protein, 87 aa, Rattus norvegicus
MRTLTLLTTLLLLALHTQAESPQGSTKEAPDEEQDISVFFGGDKGTALQDAAVKAGVTCSCRTSSCRFGERLSGACRLNGRIYRLCC

SEQ ID NO: 638 - protein, 87 aa, Rattus norvegicus
MRTLILLTTLLLLALHTQAESPQGSTKEAPDEEQDISVFFGGDKGTALQDAAVKAGVTCSCRTSSCRFGERLSGACRLNGRIYRLCC

SEQ ID NO: 639 - protein, 95 aa, Oryctolagus cuniculus
MRTLALLAAILLVTLQAQAELHSGMADDGVDQQQPRAQDLDVAVYIKQDETSPLEVLGAKAGVSCTCRRFSCGFGERASGSCTVNGVRHTLCCRR

SEQ ID NO: 640 - protein, 93 aa, Rattus norvegicus
MRTLTLLITLLLLALHTQAESPQERAKAAPDQDMVMEDQDIFISFGGYKGTVLQDAVVKAGQACYCRIGACVSGERLTGACGLNGRIYRLCCR

SEQ ID NO: 641 - protein, 95 aa, Oryctolagus cuniculus
MRTLALLAAILLVTLQAQAELHSGMADDGVDQQQPRAQDLDVAVYIKQDETSPLEVLGAKAGVFCTCRGFLCGSGERASGSCTINGVRHTLCCRR

SEQ ID NO: 642 - protein, 60 aa, Bos taurus
MRLHHLLLALLFLVLSAASGISGPLSCGRNGGVCIPIRCPVPMRQIGTCFGRPVKCCRSW

SEQ ID NO: 643 - protein, 54 aa, Bos taurus
MRLHHLLLVLLFLVLSAGSGFTQVVRNPQSCRWNMGVCIPISCPGNMRQIGTCS

SEQ ID NO: 644 - protein, 178 aa, Cavia porcellus
MGTPRDAASGGPRLLLPLLLLLLLTPATAWVLSYQQAVQRAVDGINKNLADNENLFRLLSLDTQPPGDNDPYSPKPVSFTIKETVCTKMLQRPLEQCDFKENGLVQRCTGTVTLDSAFNVSSLSCLGGRRFRRMVGLRKKFRKTRKRIQKLGRKIGKTGRKVWKAWREYGQIPYPCRI

SEQ ID NO: 645 - protein, 93 aa, Cavia porcellus
MRTVPLFAACLLLTLMAQAEPLPRAADHSDTKMKGDREDHVAVISFWEEESTSLEDAGAGAGRRCICTTRTCRFPYRRLGTCIFQNRVYTFCC

SEQ ID NO: 646 - protein, 93 aa, Cavia porcellus
MRTVPLFAACLLLTLMAQAEPLPRAADHSDTKMKGDREDHVAVISFWEEESTSLQDAGAGAGRRCICTTRTCRFPYRRLGTCIFQNRVYTFCC

SEQ ID NO: 647 - protein, 93 aa, Cavia porcellus
MRTVPLFAACLLLTLMAQAEPLPRAADHSDTKMKGDREDHVAVISFWEEESTSLQDAGAGAGRRCICTTRTCRFPYRRLGTCLFQNRVYTFCC

SEQ ID NO: 648 - protein, 33 aa, Mesocricetus auratus
VTCFCRRRGCASRERHIGYCRFGNTIYRLCCRR

SEQ ID NO: 649 - protein, 31 aa, Mesocricetus auratus
CFCKRPVCDSGETQIGYCRLGNTFYRLCCRQ

SEQ ID NO: 650 - protein, 30 aa, Macaca mulatta
ACYCRIPACLAGERRYGTCFYMGRVWAFCC

SEQ ID NO: 651 - protein, 33 aa, Mesocricetus auratus
VTCFCRRRGCASRERLIGYCRFGNTIYGLCCRR

SEQ ID NO: 652 - protein, 33 aa, Mesocricetus auratus
VTCFCKRPVCDSGETQIGYCRLGNTFYRLCCRQ

SEQ ID NO: 653 - protein, 96 aa, Macaca mulatta
MRTLVILAAILLVALQAQAEPLQARTDEATAAQEQIPTDNPEVVVSLAWDESLAPKDSVPGLRKNMACYCRIPACLAGERRYGTCFYLGRVWAFCC

SEQ ID NO: 654 - protein, 94 aa, Macaca mulatta
MRTIAILAAILLFALLAQAKSLQETADDAATQEQPGEDDQDLAVSFEENGLSTLRASGSQARRTCRCRFGRCFRRESYSGSCNINGRIFSLCCR

SEQ ID NO: 655 - protein, 94 aa, Macaca mulatta
MRTIAILAAILLFALLAQAKSLQETADEAATQEQPGEDDQDLAVSFEENGLSTLRASGSQARRTCRCRFGRCFRRESYSGSCNINGRISSLCCR

SEQ ID NO: 656 - protein, 129 aa, Sus scrofa
PGLAFSGLTPEHSALARAHPCDGEQFCQNLAPEDPQGDQLLQREELGLICESCRKIIQKLEDMVGPQPNEDTVTQAASRVCDKMKILRGVCKKIMRTFLRRISKDILTGKKPQAICVDIKICKEKTGLI

SEQ ID NO: 657 - protein, 69 aa, Oncorhynchus mykiss
PKRKSATKGDEPARRSARLSARPVPKPAAKPKKAAAPKKAVKGKKAAENGDAKAEAKVQAAGDGAGNAK

SEQ ID NO: 658 - protein, 190 aa, Bos taurus
MSRRYTPLAWVLLALLGLGAAQDCGSIVSRGKWGALASKCSQRLRQPVRYVVVSHTAGSVCNTPASCQRQAQNVQYYHVRERGWCDVGYNFLIGEDGLVYEGRGWNTLGAHSGPTWNPIAIGISFMGNYMHRVPPASALRAAQSLLACGAARGYLTPNYEVKGHRDVQQTLSPGDELYKIIQQWPHYRRV

SEQ ID NO: 659 - protein, 44 aa, Opistophthalmus carinatus
GKVWDWIKSTAKKLWNSEPVKELKNTALNAAKNLVAEKIGATPS

SEQ ID NO: 660 - protein, 44 aa, Opistophthalmus carinatus
GKVWDWIKSTAKKLWNSEPVKELKNTALNAAKNFVAEKIGATPS

SEQ ID NO: 661 - protein, 44 aa, Pandinus imperator
GKVWDWIKSAAKKIWSSEPVSQLKGQVLNAAKNYVAEKIGATPT

SEQ ID NO: 662 - protein, 24 aa, Pandinus imperator
FWGALAKGALKLIPSLFSSFSKKD

SEQ ID NO: 663 - protein, 45 aa, Parabuthus schlechteri
FKLGSFLKKAWKSKLAKKLRAKGKEMLKDYAKGLLEGGSEEVPGQ

SEQ ID NO: 664 - protein, 50 aa, Litopenaeus vannamei
YRGGYTGPIPRPPPIGRPPLRLVVCACYRLSVSDARNCCIKFGSCCHLVK

SEQ ID NO: 665 - protein, 72 aa, Litopenaeus vannamei
MRLVVCLVFLASFALVCQGEAYRGGYTGPIPRPPPIGRPPFRPVCNACYRLSVSDARNCCIKFGSCCHLVKG

SEQ ID NO: 666 - protein, 72 aa, Litopenaeus vannamei
MRLVVCLVFLASFALVCQGEAYRGGYTGPIPRPPPIGRPPLRPVCNACYRLSVSDARNCCIKFGSCCHLVKG

SEQ ID NO: 667 - protein, 72 aa, Litopenaeus setiferus
MRLVVCLVFLASFALVCQGGAQRGGFTGPIPRPPPHGRPPLGPICNACYRLSFSDVRICCNFLGKCCHLVKG

SEQ ID NO: 668 - protein, 82 aa, Litopenaeus vannamei
MRLVVCLVFLASFALVCQGQVYKGGYTRPIPRPPPFVRPLPGGPIGPYNGCPVSCRGISFSQARSCCSRLGRCCHVGKGYSG

SEQ ID NO: 669 - protein, 82 aa, Litopenaeus vannamei
MRLVVCLVFLASFALVCQGQVYKGGYTRPVPRPPPFVRPLPGGPIGPYNGCPVSCRGISFSQARSCCSRLGRCCHVGKGYSG

SEQ ID NO: 670 - protein, 81 aa, Litopenaeus vannamei
MRLVVCLVFLASFALVCQGQVYKGGYTRPIPRPPFVRPVPGGPIGPYNGCPVSCRGISFSQARSCCSRLGRCCHVGKGYSG

SEQ ID NO: 671 - protein, 82 aa, Litopenaeus vannamei
MRLVVCLVFLASFALVCQGQVYKGGYTRPIPRPPPFVRPLPGGPIGPYNGCPISCRGISFSQARSCCSRLGRCCHVGKGYSG

SEQ ID NO: 672 - protein, 82 aa, Litopenaeus vannamei
MRLVVCLVFLAPFALVCHGQVYKGGYTRPIPRPPPFVRPLPGGPIGPYNGCPVSCRGISFSQARSCCSRLGRCCHVGKGYSG

SEQ ID NO: 673 - protein, 82 aa, Litopenaeus vannamei
MRLVACLVFLASFALVCQGQVYKGGYTRPIPRPPPFVRPLPGGPIGPYNGCPISCRGISFSQARSCCSRLGRCCHVGKGYSG

SEQ ID NO: 674 - protein, 82 aa, Litopenaeus vannamei
MRLVVCLVFLASFALVCQGQVYKGGYTRPIPRPPPFVRPLPGGPISPYNGCPVSCRGISFSQARSCCSRLGRCCHVGKGYSG

SEQ ID NO: 675 - protein, 82 aa, Litopenaeus vannamei
MRLVVCLVFLASFALVCQGQVYKGGYTRPIPRPPPFVRPLPGGPIGPYNGCPISCRGISFSQARSYCSRLGRCCHVGKGYSG

SEQ ID NO: 676 - protein, 82 aa, Litopenaeus vannamei
MRLVVCLVFLASFALVCQGQVYKGGYTRPIPRPPPFVRPLPGGPIGPYNGRPVSCRGISFSQARSCCSRLGRCCHVGKGYSG

SEQ ID NO: 677 - protein, 81 aa, Litopenaeus vannamei
MRLVVCLVFLASFALVCQGQVYKGGYTRPVPRPPFVRPLPGGPIGPYNGCPVSCRGISFSQARSCCSRLGRCCHVGKGYSG

SEQ ID NO: 678 - protein, 75 aa, Litopenaeus setiferus
MRLVVCLVFLASFALVCQGQGYKGPYTRPILRPYVRPVVSYNACTLSCRGITTTQARSCCTRLGRCCHVAKGYSG

SEQ ID NO: 679 - protein, 75 aa, Litopenaeus setiferus
MRLVVCLVFLASFALVCQGQGYKGPYTRPILRPYVRPVVSYNVCTLSCRGITTTQARSCCTRLGRCCHVAKGYSG

SEQ ID NO: 680 - protein, 75 aa, Litopenaeus setiferus
MRLVVCLVFLASFALVCQGQGCKGPYTRPILRPYVRPVVSYNACTLSCRGITTTQARSCCTRLGRCCHVAKGYSG

SEQ ID NO: 681 - protein, 75 aa, Litopenaeus setiferus
MRLVVCLVFLASFALVCQGQGYKGPYTRPILRPYVRPVVSYNACTLSCRGITTTQARSCSTRLGRCCHVAKGYSG

SEQ ID NO: 682 - protein, 67 aa, Litopenaeus vannamei
MRLVVCLVFLASFALVCQGHSSGYTRPLPKPSRPIFIRPIGCDVCYGIPSSTARLCCFRYGDCCHRG

SEQ ID NO: 683 - protein, 67 aa, Litopenaeus vannamei
MRLVVCLVFLASFALVCQGYSSGYTRPLPKPSRPIFIRPIGCDVCYGIPSSTARLCCFRYGDCCHRG

SEQ ID NO: 684 - protein, 67 aa, Litopenaeus setiferus
MRLLVCLVFLASFAMVCQGHSSGYTRPLRKPSRPIFIRPIGCDVCYGIPSSTARLCCFRYGDCCHLG

SEQ ID NO: 685 - protein, 94 aa, Protophormia terraenovae
MKFFMVFVVTFCLAVCFVSQSLAIPADAANDAHFVDGVQALKEIEPELHGRYKRATCDLLSGTGINHSACAAHCLLRGNRGGYCNGKGVCVCRN

SEQ ID NO: 686 - protein, 64 aa, Phyllomedusa bicolor
MVFLKKSLLLVLFVGLVSLSICEENKREEHEEIEENKEKAEEKRGWMSKIASGIGTFLSGMQQG

SEQ ID NO: 687 - protein, 25 aa, Pseudopleuronectes americanus
GWGSFFKKAAHVGKHVGKAALHTYL

SEQ ID NO: 688 - protein, 68 aa, Pseudopleuronectes americanus
MKFTATFLMMAIFVLMVEPGECGWGSFFKKAAHVGKHVGKAALTHYLGDKQELNKRAVDEDPNVIVFE

SEQ ID NO: 689 - protein, 68 aa, Pseudopleuronectes americanus
MKFTATFLMIAIFVLMVEPGECGWGSFFKKAAHVGKHVGKAALTHYLGDKQELNKRAVDEDPNVIVFE

SEQ ID NO: 690 - protein, 68 aa, Pseudopleuronectes americanus
MKFTATFLMMFIFVLMVEPGECGWGSIFKHGRHAAKHIGHAAVNHYLGEQQDLDKRAVDEDPNVIVFE

SEQ ID NO: 691 - protein, 60 aa, Pseudopleuronectes americanus
MKFTATFLMIAIFVLMVEPGECGWGSFFKKAAHVGKHVGKAALTHYLGDKQELNKRAVDE

SEQ ID NO: 692 - protein, 60 aa, Pseudopleuronectes americanus
MKFTATFLMMFIFVLMVEPGECGWGSIFKHGRHAAKHIGHAAVNHYLGEQQDLDKRAVDE

SEQ ID NO: 693 - protein, 89 aa, Pseudopleuronectes americanus
MKFTATFLLLFIFVLMVDLGEGRRKKKGSKRKGSKGKGSKGKGRWLERIGKAGGIIIGGALDHLGQGQVQGPDYDYQEGEELNKRAVDE

SEQ ID NO: 694 - protein, 72 aa, Pseudopleuronectes americanus
MKFTATFLLLFIFVLMVDLGEGRRKRKWLRRIGKGVKIIGGAALDHLGQGQVQGQDYDYQEGQELNKRAVDE

SEQ ID NO: 695 - protein, 61 aa, Pseudopleuronectes americanus
MKFTATFLVLSLVVLMAEPGECFLGALIKGAIHGGRFIHGMIQNHHGYDEQQELNKRAVDE

SEQ ID NO: 696 - protein, 18 aa, Limulus polyphemus
RRWCFRVCYRGFCYRKCR

SEQ ID NO: 697 - protein, 18 aa, Limulus polyphemus
RRWCFRVCYKGFCYRKCR

SEQ ID NO: 698 - protein, 30 aa, Pachycondyla goeldii
GWKDWAKKAGGWLKKKGPGMAKAALKAAMQ

SEQ ID NO: 699 - protein, 30 aa, Pachycondyla goeldii
GWKDWLKKGKEWLKAKGPGIVKAALQAATQ

SEQ ID NO: 700 - protein, 30 aa, Pachycondyla goeldii
GWKDWLNKGKEWLKKKGPGIMKAALKAATQ

SEQ ID NO: 701 - protein, 29 aa, Pachycondyla goeldii
DFKDWMKTAGEWLKKKGPGILKAAMAAAT

SEQ ID NO: 702 - protein, 30 aa, Pachycondyla goeldii
GLKDWVKIAGGWLKKKGPGILKAAMAAATQ

SEQ ID NO: 703 - protein, 18 aa, Pachycondyla goeldii
GLVDVLGKVGGLIKKLLP

SEQ ID NO: 704 - protein, 19 aa, Pachycondyla goeldii
GLVDVLGKVGGLIKKLLPG

SEQ ID NO: 705 - protein, 24 aa, Pachycondyla goeldii
LLKELWTKMKGAGKAVLGKIKGLL

SEQ ID NO: 706 - protein, 24 aa, Pachycondyla goeldii
LLKELWTKIKGAGKAVLGKIKGLL

SEQ ID NO: 707 - protein, 25 aa, Pachycondyla goeldii
WLGSALKIGAKLLPSVVGLFKKKKQ

SEQ ID NO: 708 - protein, 25 aa, Pachycondyla goeldii
WLGSALKIGAKLLPSVVGLFQKKKK

SEQ ID NO: 709 - protein, 26 aa, Pachycondyla goeldii
GIWGTLAKIGIKAVPRVISMLKKKKQ

SEQ ID NO: 710 - protein, 26 aa, Pachycondyla goeldii
GIWGTALKWGVKLLPKLVGMAQTKKQ

SEQ ID NO: 711 - protein, 24 aa, Pachycondyla goeldii
FWGALIKGAAKLIPSVVGLFKKKQ

SEQ ID NO: 712 - protein, 20 aa, Pachycondyla goeldii
FIGTALGIASAIPAIVKLFK

SEQ ID NO: 713 - protein, 74 aa, Boophilus microplus
  misc_feature (9)..(9): Xaa can be any naturally occurring amino acid
  misc_feature (13)..(13): Xaa can be any naturally occurring amino acid
MRGIYICLXFVLXCGLVSGLADVPAESEMAHLRVRRGFGCPFNQGACHRHCRSIRRRGGYCAGLIKQTCTCYRN

SEQ ID NO: 714 - protein, 76 aa, Ixodes ricinus
MKVLAVSLAFLLIAGLISTSLAQNEEGGEKELVRVRRGGYYCPFFQDKCHRHCRSFGRKAGYCGGFLKKTCICVMK

SEQ ID NO: 715 - protein, 678 aa, Riptortus clavatus
MRSPRVIHLACVIAYIVAVEAGDKPVYLPRPTPPRPIHPRLAREVGWELEGQGLSPLSEAELLPEVRERRSPVDKGGYLPRPTPPRPVYRSRRDASLESELSPLSVAEVLPEVRERRSPVDKGGYLPRPTPPRPVYRSRRDASLESELSPLSEAEVLPEVRERRSPVDKGGYLPRPTPPRPVYRSRRVASLESELSPLSEAEVLPEVRERRSPVDKGGYLPRPTPPRPVYRSRRDASLESELSPLSEEEVLPEVRERGSPVDKGGYLPRPTPPRPVYRSRRDASLESELSPLSVAEDLPEVRERRSPVDKGGYLPRPTPPRPVYRSRRDASLESELSPLSEAEVLPEVRERRSPVDKGGYLPRPTPPRPVYRSRRDASLESELSPLSEAEVLPEVRERRSPVDKGGYLPRPTPPRPVYRSRRDASLESELSPLSEAEVLPEVRERRSPVDKGGYLPRPTPPRPVYRSRRDASLESELSPLSEAEVLPEVRERRSPVDKGGYLPRPTPPRPVYRSRRDATLESELSPSSEAEVLPEVRERRSPVDKGGYLPRPTPPRPVYRSRRDASLESELSPLSEAEVLPEVRERRSPVDKGGYLPRPTPPRPVYRSRRDASLESELSPLSEAEGLPEVRERRSPGGQGGYLPRPTPRTPLCRSRRDANLDAEQSPVSEGVVLPEVR

SEQ ID NO: 716 - protein, 150 aa, Riptortus clavatus
MHIARFCLLSSMAVLALSAGYVSGAVIEIPDEILDSARFISLYSDGLRQKRQLNLSGPGSEHAGTIRLDGQRNIFDNGRTRVDGTGSYQLDYARGMKPIHGAGLGAEVNHNIWRGRGGQSLDLYGGATRQFNFGNRPNEWGAHGGIRYNF

SEQ ID NO: 717 - protein, 263 aa, Bos taurus
MARFLGLCTWLLALGPGLLATVRAECSQDCATCSYRLARPTDLNPLACTLECEGKLPSLKTWETCKELLQLTKLELPPDATSALSKQEESHLLAKKYGGFMKRYGGFMKKMDELYPLEVEEEANGGEVLGKRYGGFMKKDAEEDDGLGNSSNLLKELLGAGDQREGSLHQEGSDAEDVSKRYGGFMRGLKRSPHLEDETKELQKRYGGFMRRVGRPEWWMDYQKRYGGFLKRFAEPLPSEEEGESYSKEVPEMEKRYGGFMRF

SEQ ID NO: 718 - protein, 212 aa, Sus scrofa
LLLLALVVPSASAQALSYREAVLRAVDRLNEQSSEANLYRLLELDQPPKADEDPGTPKPVSFTVKETVCPRPTRQPPELCDFKENGRVKQCVGTVTLDQIKDPLDITCNEGVRRFPWWWPFLRRPRLRRQAFPPPNVPGPRFPPPNFPGPRFPPPNFPGPRFPPPNFPGPRFPPPNFPGPPFPPPIFPGPWFPPPPPFRPPPFGPPRFPGRR

SEQ ID NO: 719 - protein, 228 aa, Sus scrofa
METQRASLCLGRWSLWLLLLALVVPSASAQALSYREAVLRAVDRLNEQSSEANLYRLLELDQPPKADEDPGTPKPVSFTVKETVCPRPTRRPPELCDFKENGRVKQCVGTVTLDQIKDPLDITCNEGVRRFPWWWPFLRRPRLRRQAFPPPNVPGPRFPPPNVPGPRFPPPNFPGPRFPPPNFPGPRFPPPNFPGPPFPPPIFPGPWFPPPPPFRPPPFGPPRFPGRR

SEQ ID NO: 720 - protein, 149 aa, Sus scrofa
METQRASLCLGRWSLWLLLLALVVPSASAQALSYREAVLRAVDRLNEQSSEANLYRLLELDQPPKADEDPGTPKPVSFTVKETVCPRPTRQPPELCDFKENGRVKQCVGTVTLDQIKDPLDITCNEVQGVRGGRLCYCRRRFCVCVGRG

SEQ ID NO: 721 - protein, 147 aa, Sus scrofa
METQRASLCLGRWSLWLLLLALVVPSASAQALSYREAVLRAVDRLNEQSSEANLYRLLELDQPPKADEDPGTPKPVSFTVKETVCPRPTRQPPELCDFKENGRVKQCVGTVTLDQIKDPLDITCNEVQGVRGGRLCYCRRRFCICVG

SEQ ID NO: 722 - protein, 149 aa, Sus scrofa
METQRASLCLGRWSLWLLLLALVVPSASAQALSYREAVLRAVDRLNEQSSEANLYRLLELDQPPKADEDPGTPKPVSFTVKETVCPRPTRQPPELCDFKENGRVKQCVGTVTLDQIKDPLDITCNEVQGVRGGGLCYCRRRFCVCVGRG

SEQ ID NO: 723 - protein, 149 aa, Sus scrofa
METQRASLCLGRWSLWLLLLALVVPSASAQALSYREAVLRAVDRLNEQSSEANLYRLLELDQPPKADEDPGTPKPVSFTVKETVCPRPTRQPPELCDFKENGRVKQCVGTVTLDQIKDPLDITCNEVQGVRGGRLCYCRGWICFCVGRG

SEQ ID NO: 724 - protein, 149 aa, Sus scrofa
METQRASLCLGRWSLWLLLLGLVVPSASAQALSYREAVLRAVDRLNEQSSEANLYRLLELDQPPKADEDPGTPKPVSFTVKETVCPRPTRQPPELCDFKENGRVKQCVGTVTLDQIKDPLDITCNEVQGVRGGRLCYCRPRFCVCVGRG

SEQ ID NO: 725 - protein, 19 aa, Sus scrofa
  misc_feature (19)..(19): Xaa can be any naturally occurring amino acid
RGGRLCYCRRRFCVCVGRX

SEQ ID NO: 726 - protein, 24 aa, Pseudis paradoxa
GLNTLKKVFQGLHEAIKLINNHVQ

SEQ ID NO: 727 - protein, 24 aa, Pseudis paradoxa
GLNALKKVFQGIHEAIKLINNHVQ

SEQ ID NO: 728 - protein, 23 aa, Pseudis paradoxa
GINTLKKVIQGLHEVIKLVSNHE

SEQ ID NO: 729 - protein, 23 aa, Pseudis paradoxa
GINTLKKVIQGLHEVIKLVSNHA

SEQ ID NO: 730 - protein, 188 aa, Litopenaeus setiferus
MKGIKAVILCGLFTAVLAGKYRGFGQPLGGLGVPGGGVGVGVGGGLGGGLGGGLGGGLGGGLGGGLGGLGGGLGGLGGGLGGGLGGGLGGGLGGGLGGSHGTSDCRYWCKTPEGQAYCCESAHEPETPVGTKPLDCPQVRPTCPRFHGPPTTCSNDYKCAGLDKCCFDRCLGEHVCKPPSFFGQQIFG

SEQ ID NO: 731 - protein, 123 aa, Litopenaeus setiferus
MKGLGVILCCVLAVVPAHAGPGGFPGGVPGRFPSATAPPATCRRWCKTPENQAYCCETIFEPEAPVGTKPLDCPQVRPTCPRFHGPPVTCSSDYKCGGVDKCCFDRCLGEHVCKPPSFYSQFP

SEQ ID NO: 732 - protein, 141 aa, Litopenaeus setiferus
MKGLGVILCCVLAVVPAHAGPGGFSGGVPGGFPGGRPGGFPGGVPGGFPSATAPPATCRRWCKTPENQAYCCETIFEPEAPVGTKPLDCPQVRPTCPPTRFGGRPVTCSSDYKCGGLDKCCFDRCLGEHVCKPPSFYSQFR

SEQ ID NO: 733 - protein, 163 aa, Litopenaeus vannamei
MKGIKAVILCGLFTAVLAGKFRGFGQPFGGLGGPGGGVGVGGGFPGGGLGVGGGLGVGGGLGVGGGLGVGGGLGTGTSDCRYWCKTPEGQAYCCESAHEPETPVGTKILDCPQVRPTCPRFHGPPTTCSNDYKCAGLDKCCFDRCLGEHVCKPPSFFGSQVFG

SEQ ID NO: 734 - protein, 163 aa, Litopenaeus vannamei
MKGIKAVILCGLFTAVLAGKFRGFGQPFGGLGGPGGGVGVGGGFPGGGLGVGGGLGVGGGLGVGGGLGVGGGLGTGTSDCRYWCKTPEGQAYCCESAHEPETPVGTKPLDCPQVRPTCPRFHGPPTTCSNDYKCAGLDKCCFDRCLGEHVCKPPSFFGSQVFG

SEQ ID NO: 735 - protein, 169 aa, Litopenaeus vannamei
MKGIKAVILCGLFTAVLAGKFRGFGQPFGGLGGPGGGVGVGGGFPGGGLGVGGGLGVGGGLGVGGGLGVGGGLGVGGGLGTGTSDCRYWCKTPEGQAYCCESAHEPETPVGTKILDCPQVRPTCPRFHGPPTTCSNDYKCAGLDKCCFDRCLGEHVCKPPSFFGSQVFG

SEQ ID NO: 736 - protein, 163 aa, Litopenaeus vannamei
MKGIKAVILCGLFTAVLAGKFRGFGQPFGGLGGPGGSVGVGGGFPGGGLGVGGGLGVGGGLGVGGGLGVGGGLGTGTSDCRYWCKTPEGQAYCCESAHEPETPVGTKPLDCPQVRPTCPRFHGPPTTCSNDYKCAGLDKCCFDRCLGEHVCKPPSFFGSQVFG

SEQ ID NO: 737 - protein, 151 aa, Litopenaeus vannamei
MKGIKAVILCGLFTAVLAGKFRGFGRPFGGLGGPGGGVGVGGGFPGGGLGVGGGLGVGGGLGTGTSDCRYWCKTPEGQAYCCESAHEPETPVGTKPLDCPQVRPTCPRFHGPPTTCSNDYKCAGLDKCCFDRCLGEHVCKPPSFFGSQVFG

SEQ ID NO: 738 - protein, 163 aa, Litopenaeus vannamei
MKGIKAVILCGLFTAVLAGKFRGFGRPFGGLGGPGGGVGVGGGFPGGGLGVGGGLGVGGGLGVGGGLGVGGGLGTGTSDYRYWCKTPEGQAYCCESAHEPETPVGTKPLDCPQVRPTCPRFHGPPTTCSNDYKCAGLDKCCFDRCLGEHVCKPPSFFGSQVFG

SEQ ID NO: 739 - protein, 79 aa, Mus musculus
MKTFLFLFAVLFFLDPAKNAFFDEKCSRVNGRCTASCLKNEELVALCQKNLKCCVTVQPCGKSKSNQSDEGSGHMGTWG

SEQ ID NO: 740 - protein, 63 aa, Mus musculus
MPQTFFVFCFLFFVFLQLFPGTGEIAVCETCRLGRGKCRRACIESEKIVGWCKLNFFCCRERI

SEQ ID NO: 741 - protein, 64 aa, Mus musculus
MRIFSLIVAGLVLLIQLYPAWGTLYRRFLCKKMNGQCEAECFTFEQKIGTCQANFLCCRKRKEH

SEQ ID NO: 742 - protein, 67 aa, Mus musculus
MRTLCSLLLICCLLFSYTTPAANSIIGVSEMERCHKKGGYCYFYCFSSHKKIGSCFPEWPRCCKNIK

SEQ ID NO: 743 - protein, 77 aa, Mus musculus
MRTLCSLLLICCLLFSYTTPAVGDLKHLILKAQLARCYKFGGFCYNSMCPPHTKFIGNCHPDHLHCCINMKELEGST

SEQ ID NO: 744 - protein, 73 aa, Mus musculus
MRTLCSLLLICCLLFSYTTPAVGDLKHLILKAQLTRCYKFGGFCHYNICPGNSRFMSNCHPENLRCCKNIKQF

SEQ ID NO: 745 - protein, 61 aa, Mesobuthus martensi
MTYAILIIVSLLLISDRISNVVDKYCSENPLDCNEHCLKTKNQIGICHGANGNEKCSCMES

SEQ ID NO: 746 - protein, 64 aa, Xenopus laevis
MYKQIFLCLIIAALCATIMAEASAFADADEDDDKRYVRGMASKAGAIAGKIAKVALKALGRRDS

SEQ ID NO: 747 - protein, 20 aa, Pyrrhocoris apterus
VDKGSYLPRPTPPRPIYNRN

SEQ ID NO: 748 - protein, 66 aa, Rana catesbeiana
MFTLKKSLLLLFFLGTINLSLCEEERNAEEERRDNPDERDVEVEKRFLGGLIKIVPAMICAVTKKC

SEQ ID NO: 749 - protein, 20 aa, Rana clamitans
FLGGLMKAFPALICAVTKKC

SEQ ID NO: 750 - protein, 20 aa, Rana clamitans
FLGGLMKAFPAIICAVTKKC

SEQ ID NO: 751 - protein, 25 aa, Rana clamitans
SMLSVLKNLGKVGLGLVACKINKQC

SEQ ID NO: 752 - protein, 28 aa, Rana berlandieri
GLLDTIKGVAKTVAASMLDKLKCKISGC

SEQ ID NO: 753 - protein, 31 aa, Rana clamitans
GLFLDTLKGAAKDVAGKLLEGLKCKIAGCKP

SEQ ID NO: 754 - protein, 27 aa, Rana clamitans
GLFLDTLKGLAGKLLQGLKCIKAGCKP

SEQ ID NO: 755 - protein, 32 aa, Rana luteiventris
GILSSIKGVAKGVAKNVAAQLLDTLKCKITGC

SEQ ID NO: 756 - protein, 27 aa, Rana pipiens
LMDTVKNVAKNLAGHMLDKLKCKITGC

SEQ ID NO: 757 - protein, 32 aa, Rana luteiventris
GILDSFKGVAKGVAKDLAGKLLDKLKCKITGC

SEQ ID NO: 758 - protein, 142 aa, Oryctes rhinoceros
MMKLYIVFGFIAFSAAYVVPEGYYEPEYYPADGYESERVARASPAELIFDEDLADEPEVEEPQYYIRTRRSLQPGAPNFPMPGSQLPTSITSNIEKQGPNTAATINAQHKTDRYDVGATWSKVIRGPGRSKPNWSIGGTYRW

SEQ ID NO: 759 - protein, 95 aa, Apis mellifera
MKIYFIVGLLFMAMVAIMAAPVEDEFEPLEHFENEERADRHRRVTCDLLSFKGQVNDSACAANCLSLGKAGGHCEKVGCICRKTSFKDLWDKRFG

SEQ ID NO: 760 - protein, 33 aa, Rana rugosa
GLLNTFKDWAISIAKGAGKGVLTTLSCKLDKSC

SEQ ID NO: 761 - protein, 33 aa, Rana rugosa
SLFSLIKAGAKFLGKNLLKQGAQYAACKVSKEC

SEQ ID NO: 762 - protein, 37 aa, Rana rugosa
GILDSFKQFAKGVGKDLIKGAAQGVLSTMSCKLAKTC

SEQ ID NO: 763 - protein, 88 aa, Sarcophaga peregrina
MKFLTSLLLLFVVVMVSAVNLSMAKESANQLTERLQELDGAAIQEPAELNRHKRLTCEIDRSLCLLHCRLKGYLRAYCSQQKVCRCVQ

SEQ ID NO: 764 - protein, 40 aa, Sarcophaga peregrina
ATCDLLSGIGVQHSACALHCVFRGNRGGYCTGKGICVCRN

SEQ ID NO: 765 - protein, 94 aa, Sarcophaga peregrina
MKSFIVLAVTLCLAAFFMGQSVASPAAAAEESKFVDGLHALKTIEPELHGRYKRATCDLLSGTGINHSACAAHCLLRGNRGGYCNGKAVCVCRN

SEQ ID NO: 766 - protein, 63 aa, Sarcophaga peregrina
MNFQNIFIFVALILAVFAGQSQAGWLKKIGKKIERVGQHTRDATIQGLGIAQQAANVAATARG

SEQ ID NO: 767 - protein, 63 aa, Sarcophaga peregrina
MNFNKVFIFVALILAVFAGQSQAGWLKKIGKKIERVGQHTRDATIQVIGVAQQAANVAATARG

SEQ ID NO: 768 - protein, 39 aa, Sarcophaga peregrina
GWLRKIGKKIERVGQHTRDATIQVLGIAQQAANVAATAR

SEQ ID NO: 769 - protein, 40 aa, Sarcophaga peregrina
GWIRDFGKRIERVGQHTRDATIQTIAVAQQAANVAATLKG

SEQ ID NO: 770 - protein, 265 aa, Sarcophaga peregrina
MKSFVLFAACMAIIALGSLAHAYPQKLPVPIPPPSNPPVAVLQNSVATNSKGGQDVSVKLSATNLGNNHVQPIAEVFAEGNTKGGNVLRGATVGVQGHGLGASVTKTQTDTKIKGLDFQPQLSSSTLALQGDRLGASISRDVNRGVSDTFTKSVSANVFRNDNHNLDATVFRSDVRQNNGFNFQKTGGMLDYSHANGHGLNAGLTHFSGIGNQANVGGSSTLFKSNDGSLSLKANAGGSQWLSGPFSNQRDYNVGLSLTHHGCGG

SEQ ID NO: 771 - protein, 294 aa, Sarcophaga peregrina
MKSFVFFAACFAIVALNSLAHAYPQKLPVPIPPPTNPPVAAFHNSVATNSKGGQDVSVKLAATNLGNKHVQPIAEVFAKGNTQGGNVLRGATVGVQGHGLGASVTKTQDGIAESFRKQAEANLRLGDSASLIGKVSQTDTKIKGIDFKPQLSSSSLALQGDRLGASISRDVNRGVSDTLTKSISANVFRNDNHNLDASVFRSDVRQNNGFNFQKTGGMLDYSHANGHGLNAGLTRFSGIGNQANVGGYSTLFRSNDGLTSLKANAGGSQWLSGPFANQRDYSFGLGLSHNAWRG

SEQ ID NO: 772 - protein, 294 aa, Sarcophaga peregrina
MKSFVLFAACMAIVALSSLAHAYPQKLPVPIPPPTNPPVAAFHNSVATNSKGGQDVSVKLAATNLGNKHVQPIAEVFAEGNTKGGNVIRGATVGVQGHGLGASVTKSGNGIAESFRKQAEANLRLGDSASLIGKVSQTDTKIKGIDFKPQLSSSSLALQGDRLGASISRDVNRGVSDTLTKSISANVFRNDNHNLDASVFRSDVRQNNGFNFQKTGGMLDYSHANGHGLNAGLTRFSGIGNQANVGGYSTLFRSNDGLTSLKANAGGSQWLSGPFANQRDYSFGLGLSHNAWRG

SEQ ID NO: 773 - protein, 294 aa, Sarcophaga peregrina
MKSFVFFAACMAIIALSSLVQAYPQKLPVPIPPPTNPPVAAFHNSVATNSKGGQDVSVKLAATNLGNKHVQPIAEVFAEGNTKGGNVLRGATVGVQGHGLGASVTKSQDGIAESFRKQAEANLRLGDSASLIGKVSQTDTKIKGIDFKPQLSSSSLALQGDRLGASISRDVNRGVSDTLTKSVSANLFRNDNHNLDASVFRSDVRQNNGFNFQKTGGMLDYSHANGHGLNAGLTRFSGIGNQATVGGYSTLFRSNDGLTSLKANAGGSQWLSGPFANQRDYSFGLGLSHNAWRG

SEQ ID NO: 774 - protein, 94 aa, Pandinus imperator
MNSKLTALIFLGLIAIAYCGWINEEKIQKKIDERMGNTVLGGMAKAIVHKMAKNEFQCMANMDMLGNCEKHCQTSGEKGYCHGTKCKCGTPLSY

SEQ ID NO: 775 - protein, 646 aa, Bos taurus
MQPAALLGLLGATVVAAVSSMPVDIRNHNEEVVTHCIIEVLSNALLKSSAPPITPECRQVLKKNGKELKNEEKSENENTRFEVRLLRDPADTSEAPGLSSREDSGEGDAQVPTVADTESGGHSRERAGEPPGSQVAKEAKTRYSKSEGQNREEEMVKYQKRERGEVGSEERLSEGPGKAQTAFLNQRNQTPAKKEELVSRYDTQSARGLEKSHSRERSSQESGEETKSQENWPQELQRHPEGQEAPGESEEDASPEVDKRHSRPRHHHGRSRPDRSSQEGNPPLEEESHVGTGNSDEEKARHPAHFRALEEGAEYGEEVRRHSAAQAPGDLQGARFGGRGRGEHQALRRPSEESLEQENKRHGLSPDLNMAQGYSEESEEERGPAPGPSYRARGGEAAAYSTLGQTDEKRFLGETHHRVQESQRDKARRRLPGELRNYLDYGEEKGEEAARGKWQPQGDPRDADENREEARLRGKQYAPHHITEKRLGELLNPFYDPSQWKSSRFERKDPMDDSFLEGEEENGLTLNEKNFFPEYNYDWWEKKPFEEDVNWGYEKRNPVPKLDLKRQYDRVAELDQLLHYRKKSAEFPDFYDSEEQMSPQHTAENEEEKAGQGVLTEEEEKELENLAAMDLELQKIAEKFSGTRRG

SEQ ID NO: 776 - protein, 93 aa, Mus musculus
MKKLVLLSALVLLAYQVQTDPIQNTDEETNTEEQPGEEDQAVSVSFGGQEGSALHEKLSRDLICLCRKRRCNRGELFYGTCAGPFLRCCRRRR

SEQ ID NO: 777 - protein, 93 aa, Mus musculus
MKTLVLLSALILLAYQVQTDPIQNTDEETNTEEQPGEDDQAVSVSFGGQEGSALHEKLSRDLICLCRNRRCNRGELFYGTCAGPFLRCCRRRR

SEQ ID NO: 778 - protein, 95 aa, Mus musculus
MKTLVLLSALVLLAFQVQADPIQNTDEETNTEEQAGEEDQAVSVSFGDPEGSALHEKSSRDLICYCRKGGCNRGEQVYGTCSGRLLFCCRRRHRH

SEQ ID NO: 779 - protein, 95 aa, Mus musculus
MKTLVLLSALVLLAFQVQADPIQNTDEETNTEEQAGEEDQAVSVSFGDPEGSALHEKSSRDLICYCRKGGCNRGEQVYGTCSGRLLLCCRRRHRH

SEQ ID NO: 780 - protein, 95 aa, Mus musculus
MKTLVLLSALVLLAFQVQADPIQNTDEETNTEEQPGEEDQAVSVSFGDPEGSALHEKSSRDLICYCRKGGCNRGEQVYGTCSGRLLFCCRRRHRH

SEQ ID NO: 781 - protein, 80 aa, Mus musculus
MKLLGLSLLAVTILLCCNMARPEIKKKNVFSKPGYCPEYRVPCPFVLIPKCRRDKGCKDALKCCFFYCQMRCVDPWESPE

SEQ ID NO: 782 - protein, 85 aa, Mus musculus
MWPNSILVLMTLLISSTLVTGGGVKGEEKRVCPPDYVRCIRQDDPQCYSDNDCGDQEICCFWQCGFKCVLPVKDNSEEQIPQSKV

SEQ ID NO: 783 - protein, 25 aa, Pseudacanthotermes spiniger
HVDKKVADKVLLLKQLRIMRLLTRL

SEQ ID NO: 784 - protein, 20 aa, Styela clava
  misc_feature (2)..(2): Xaa can be any naturally occurring amino acid
  misc_feature (8)..(8): Xaa can be any naturally occurring amino acid
GXFGKAFXSVSNFAKKHKTA

SEQ ID NO: 785 - protein, 20 aa, Styela clava
  misc_feature (2)..(2): Xaa can be any naturally occurring amino acid
GXFGPAFHSVSNFAKKHKTA

SEQ ID NO: 786 - protein, 80 aa, Styela clava
MQMKATILIVLVALFMIQQSEAGWFGKAFRSVSNFYKKHKTYIHAGLSAATLLGDMTDEEFQEFMQDIEQAREEELLSRQ

SEQ ID NO: 787 - protein, 81 aa, Styela clava
MQMKATILIVLVALFMIQQSEAGWLRKAAKSVGKFYYKHKYYIKAAWQIGKHALGDMTDEEFQDFMKEVEQAREEELQSRQ

SEQ ID NO: 788 - protein, 81 aa, Styela clava
MQMKATILIVLVALFMIQQSEAGWLRKAAKSVGKFYYKHKYYIKAAWKIGRHALGDMTDEEFQDFMKEVEQAREEELQSRQ

SEQ ID NO: 789 - protein, 195 aa, Caenorhabditis elegans
MFRKLIIATFVLSLCDLANSVTICSSSSLLSTFTDPLCTSWCKVRFCSSGSCRSVMSGSDPTCECESCGFGSWFGSSSDSNSNQPVSGQYYAGGSGGEMATPNYGNNNGYNNGYNNGNNMRYNDNNGYNTNNGYRGQPTPGYGNSNSNFNSNQQYSYQQYYNNRNNQYGNSGYGNAGQAGQTGYPSGYQNLKKKR

SEQ ID NO: 790 - protein, 98 aa, Tachypleus tridentatus
MASSFMFAVVVLFISLAANVESYLAFRCGRYSPCLDDGPNVNLYSCCSFYNCHKCLARLENCPKGLHYNAYLKVCDWPSKAGCTSVNKECHLWKTGRK

SEQ ID NO: 791 - protein, 77 aa, Tachypleus tridentatus
MKKLVIALCLMMVLAVMVEEAEAKWCFRVCYRGICYRRCRGKRNEVRQYRDRGYDVRAIPEETFFTRQDEDEDDDEE

SEQ ID NO: 792 - protein, 77 aa, Tachypleus tridentatus
MKKLVIALCLMMVLAVMVEEAEARWCFRVCYRGICYRKCRGKRNEVRQYRDRGYDVRAIPDETFFTRQDEDEDDDEE

SEQ ID NO: 793 - protein, 67 aa, Tachypleus tridentatus
MKLQNTLILIGCLFLMGAMIGDAYSRCQLQGFNCVVRSYGLPTIPCCRGLTCRSYFPGSTYGRCQRY

SEQ ID NO: 794 - protein, 13 aa, Rana temporaria
FLPLIGRVLSGIL

SEQ ID NO: 795 - protein, 61 aa, Rana temporaria
MFTLKKSLLLLFFLGTINLSLCEEERNAEEERRDEPDERDVQVEKRLLPIVGNLLKSLLGK

SEQ ID NO: 796 - protein, 13 aa, Rana temporaria
LLPILGNLLNGLL

SEQ ID NO: 797 - protein, 13 aa, Rana temporaria
LLPIVGNLLNSLL

SEQ ID NO: 798 - protein, 13 aa, Rana temporaria
VLPIIGNLLNSLL

SEQ ID NO: 799 - protein, 13 aa, Rana temporaria
FLPLIGKVLSGIL

SEQ ID NO: 800 - protein, 61 aa, Rana temporaria
MFTLKKSLLLLFFLGTINLSLCEEERDADEERRDDLEERDVEVEKRFFPVIGRILNGILGK

SEQ ID NO: 801 - protein, 58 aa, Rana temporaria
MFTLKKSLLLLFFLGTINLSLCEEERNAEEERRDEPDERDVQVEKRLSPNLLKSLLGK

SEQ ID NO: 802 - protein, 10 aa, Rana temporaria
LLPNLLKSLL

SEQ ID NO: 803 - protein, 13 aa, Rana temporaria
FVQWFSKFLGRIL

SEQ ID NO: 804 - protein, 13 aa, Rana clamitans
FLPFLAKILTGVL

SEQ ID NO: 805 - protein, 13 aa, Rana clamitans
FLPLFASLIGKLL

SEQ ID NO: 806 - protein, 13 aa, Rana clamitans
FLPFLASLLTKVL

SEQ ID NO: 807 - protein, 13 aa, Rana clamitans
FLPFLASLLSKVL

SEQ ID NO: 808 - protein, 13 aa, Rana clamitans
FLPFLATLLSKVL

SEQ ID NO: 809 - protein, 13 aa, Rana japonica
ILPLVGNLLNDLL

SEQ ID NO: 810 - protein, 13 aa, Rana luteiventris
VLPLISMALGKLL

SEQ ID NO: 811 - protein, 14 aa, Rana luteiventris
NFLGTLINLAKKIM

SEQ ID NO: 812 - protein, 14 aa, Rana luteiventris
FLPILINLIHKGLL

SEQ ID NO: 813 - protein, 13 aa, Rana pipiens
FLPIVGKLLSGLL

SEQ ID NO: 814 - protein, 84 aa, Tenebrio molitor
MKLTIFALVACFFILQIAAFPLEEAATAEEIEQGEHIRVKRVTCDILSVEAKGVKLNDAACAAHCLFRGRSGGYCNGKRVCVCR

SEQ ID NO: 815 - protein, 96 aa, Tenebrio molitor
MKTFVICLILVVAVSAAPDHHDGHLGGHQTGHQGGQQGGHLGGQQGGHLGGHQGGQPGGHLGGHQGGIGGTGGQQHGQHGPGTGAGHQGGYKTHGH

SEQ ID NO: 816 - protein, 36 aa, Pseudacanthotermes spiniger
ACNFQSCWATCQAQHSIYFRRAFCDRSQCKCVFVRG

SEQ ID NO: 817 - protein, 41 aa, Mus musculus
MKTLVLLSALFLLAFQVQADPIQNTDEETNTEVQPQEEDQA

SEQ ID NO: 818 - protein, 40 aa, Mus musculus
MKTLVLLSPSSCWPSRSRLILSKTQMKRLKLRSSQRKRTR

SEQ ID NO: 819 - protein, 83 aa, Mus musculus
MRLALLLLAILVATELVVSGKNPILQCMGNRGFCRSSCKKSEQAYFYCRTFQMCCLQSYVRISLTGVDDNTNWSYEKHWPRIP

SEQ ID NO: 820 - protein, 21 aa, Podisus maculiventris
GSKKPVPIIYCNRRTGKCQRM

SEQ ID NO: 821 - protein, 18 aa, Macaca mulatta
GFCRCLCRRGVCRCICTR

SEQ ID NO: 822 - protein, 76 aa, Macaca mulatta
MRTFALLTAMLLLVALHAQAEARQARADEAAAQQQPGTDDQGMAHSFTWPENAALPLSESAKGLRCICTRGFCRLL

SEQ ID NO: 823 - protein, 76 aa, Macaca mulatta
MRTFALLTAMLLLVALHAQAEARQARADEAAAQQQPGADDQGMAHSFTRPENAALPLSESARGLRCLCRRGVCQLL

SEQ ID NO: 824 - protein, 18 aa, Macaca mulatta
RCICTRGFCRCLCRRGVC

SEQ ID NO: 825 - protein, 11 aa, Hoplobatrachus tigerinus
FCTMIPIPRCY

SEQ ID NO: 826 - protein, 12 aa, Hoplobatrachus tigerinus
RVCFAIPLPICH

SEQ ID NO: 827 - protein, 12 aa, Hoplobatrachus tigerinus
RVCYAIPLPICY

SEQ ID NO: 828 - protein, 11 aa, Hoplobatrachus tigerinus
RVCYAIPLPIC

SEQ ID NO: 829 - protein, 64 aa, Bos taurus
MRLHHLLLALLFLVLSASSGFTQGVGNPVSCVRNKGICVPIRCPGNMKQIGTCVGRAVKCCRKK

SEQ ID NO: 830 - protein, 64 aa, Bos taurus
MRLHHLLLALLFLVLSAWSGFTQGVGNPVSCVRNKGICVPIRCPGSMKQIGTCVGRAVKCCRKK

SEQ ID NO: 831 - protein, 81 aa, Xenopus laevis
MYKGIFLCVLLAVICANSLATPSSDADEDNDEVERYVRGWASKIGQTLGKIAKVGLKELIQPKREAMLRSAEAQGKRPWIL

SEQ ID NO: 832 - protein, 206 aa, Zea mays
AVFTVVNQCPFTVWAASVPVGGGRQLNRGESWRITAPAGTTAARIWARTGCQFDASGRGSCRTGDCGGVVQCTGYGRAPNTLAEYALKQFNNLDFFDISLIDGFNVPMSFLPDGGSGCSRGPRCAVDVNARCPAELRQDGVCNNACPVFKKDEYCCVGSAANNCHPTNYSRYFKGQCPDAYSYPKDDATSTFTCPAGTNYKVVFCP

SEQ ID NO: 833 - protein, 29 aa, Amaranthus caudatus
VGECVRGRCPSGMCCSQFGYCGKGPKYCG

SEQ ID NO: 834 - protein, 206 aa, Zea mays
AVFTVVNQCPFTVWAASVPVGGGRQLNRGESWRITAPAGTTAARIWARTGCQFDASGRGSCRTGDCGGVVQCTGYGRAPNTLAEYALKQFNNLDFFDISILDGFNVPYSFLPDGGSGCSRGPRCAVDVNARCPAELRQDGVCNNACPVFKKDEYCCVGSAANNCHPTNYSRYFKGQCPDAYSYPKDDATSTFTCPAGTNYKVVFCP

SEQ ID NO: 835 - protein, 20 aa, Basella alba
GADFQECMKEHSQKQHQHQG

SEQ ID NO: 836 - protein, 37 aa, Linum usitatissimum
  misc_feature (33)..(33): Xaa can be any naturally occurring amino acid
ARFDIQNKCPYTVWAASVPVGGGRQLNSGQTWXIDAP

SEQ ID NO: 837 - protein, 30 aa, Diospyros texana
  misc_feature (9)..(9): Xaa can be any naturally occurring amino acid
  misc_feature (26)..(26): Xaa can be any naturally occurring amino acid
ATFDIQNKXTYTVWAAAWAPSYPGGXKQLD

SEQ ID NO: 838 - protein, 20 aa, Raphanus sativus
PQGPQQRPPLLQQCCNNLLQ

SEQ ID NO: 839 - protein, 30 aa, Raphanus sativus
PAGPFRIPRCRREFQQAQHLRACQQWLHRQ

SEQ ID NO: 840 - protein, 38 aa, Phytolacca americana
AGCIKNGGRCNASAGPPYCCSSYCFQIAGQSYGVCKNR

SEQ ID NO: 841 - protein, 41 aa, Eucommia ulmoides
QTCASRCPRPCNAGLCCSIYGYCGSGNAYCGAGNCRCQCRG

SEQ ID NO: 842 - protein, 41 aa, Eucommia ulmoides
QTCASRCPRPCNAGLCCSIYGYCGSGAAYCGAGNCRCQCRG

SEQ ID NO: 843 - protein, 171 aa, Gastrodia elata
MAASASTAVILFFAVTTMMSLSAIPAFASDRLNSDHQLDTGGSLAQGGYLFIIQNDCNLVLYDNNRAVWASGTNGKASNCFLKMQNDGNLVIYSGSRAIWASNTNRQKGNYYLILQRDRNVVIYDNSNNAIWATHTNVGNAEITVIPHSNGTAAASGAAQNKVNELYISMY

SEQ ID NO: 844 - protein, 169 aa, Gastrodia elata
MASPASSAVIFLFAVAALMSLLAMPALAASQLNAGQTLGTGQSLAQGPDQFVIQNDCNLVLYDSNRVVWASGTNGKASGCVLRMQRDGNLVIYSGSRVIWASNTNRRDDNYYLLLQRDRNVVIYDSSNNAIWATGTNVGNAAITVIPHSNGTAAASGAAQNKVNEYLRP

SEQ ID NO: 845 - protein, 92 aa, Ipomoea nil
MKFCTMFLVVLALASLLLTPSTIMAQQCGSQARGRLCGNGLCCSQWGYCGSTAAYCGAGCQSQCKSTAASATDTTTTANQSTAKSDPAGGAN

SEQ ID NO: 846 - protein, 85 aa, Capsicum annuum
MKFQVVILVLFALLLTRTSAQNCGRQAGRRVCANRLCCSQFGFCGTTREYCGAGCQSNCRRYATDTTGEGENVNNDEHKNNGGPN

SEQ ID NO: 847 - protein, 91 aa, Ipomoea nil
MKYCTMFIVLLGLGSLLLTPTTIMAQQCGRQASGRLCGNGLCCSQWGYCGSTAAYCGAGCQSQCKSTAASSTTTTTANQSTAKSDPAGGAN

SEQ ID NO: 848 - protein, 25 aa, Sinapis alba
QKLCERPSGTWSGVCGNNNACKNQC

SEQ ID NO: 849 - protein, 30 aa, Brassica napus
QKLCERPSGTWSGVCGNNNACKNQCINLEK

SEQ ID NO: 850 - protein, 27 aa, Arabidopsis thaliana
QKLCERPSGTWSGVCGNSNACKNQCIN

SEQ ID NO: 851 - protein, 51 aa, Raphanus sativus
  misc_feature (1)..(1): Xaa can be any naturally occurring amino acid
XKLCERPSGTWSGVCGNNNACKNQCINLEKARHGSCNYVFPAHKCICYFPC

SEQ ID NO: 852 - protein, 15 aa, Malva parviflora
VAGPFRIPPLRREFQ

SEQ ID NO: 853 - protein, 65 aa, Phytolacca americana
MAKVSSAYLKFALVMILLLSVISAVMSAGCIKNGGRCNASAGPPYCCSSYCFQIAGQSYGVCKNR

SEQ ID NO: 854 - protein, 16 aa, Malva parviflora
  misc_feature (11)..(11): Xaa can be any naturally occurring amino acid
  misc_feature (13)..(13): Xaa can be any naturally occurring amino acid
PAGPFRIPPRXRXEFQ

SEQ ID NO: 855 - protein, 26 aa, Sinapis alba
QKLCQRPSGTWSGVCGNNNACRNQCI

SEQ ID NO: 856 - protein, 20 aa, Malva parviflora
  misc_feature (11)..(11): Xaa can be any naturally occurring amino acid
  misc_feature (15)..(15): Xaa can be any naturally occurring amino acid
  misc_feature (17)..(17): Xaa can be any naturally occurring amino acid
PEDPQRRYQEXQREXRXQQE

SEQ ID NO: 857 - protein, 15 aa, Malva parviflora
PEDPQRRYQEEQRRE

SEQ ID NO: 858 - protein, 37 aa, Malva parviflora
  misc_feature (20)..(20): Xaa can be any naturally occurring amino acid
  misc_feature (32)..(32): Xaa can be any naturally occurring amino acid
  misc_feature (34)..(34): Xaa can be any naturally occurring amino acid
DRQIDMEEQQLEKLNKQDRXPGLRYAAKQQMXTXRMG

SEQ ID NO: 859 - protein, 38 aa, Malva parviflora
  misc_feature (26)..(29): Xaa can be any naturally occurring amino acid
  misc_feature (35)..(36): Xaa can be any naturally occurring amino acid
ITCGQVTSQVAGCLSYLQRGGAPAPXXXXGIRNLXXMA

SEQ ID NO: 860 - protein, 46 aa, Beta vulgaris
AICKKPSKFFKGACGRDADCEKACDQENWPGGVCVPFLRCECQRSC

SEQ ID NO: 861 - protein, 46 aa, Beta vulgaris
ATCRKPSMYFSGACFSDTNCQKACNREDWPNGKCLVGFKCECQRPC

SEQ ID NO: 862 - protein, 129 aa, Gastrodia elata
SDRLNSGHQLDTGGSLAEGGYLFIIQNDCNLVLYDNNRAVWASGTNGKASGCVLKMQNDGNLVIYSGSRAIWASNTNRQNGNYYLILQRDRNVVIYDNSNNAIWATHTNVGNAEITVIPHSNGTAAASG

SEQ ID NO: 863 - protein, 72 aa, Medicago sativa
MEKKSLAGLCFLFLVLFVAQEIVVTEARTCENLADKYRGPCFSGCDTHCTTKENAVSGRCRDDFRCWCTKRC

SEQ ID NO: 864 - protein, 178 aa, Gastrodia elata
MLEWGDGVFCGGCVGYLRGDSVECGNCSDRLNSGHQLDTGGSLAQGGYLFIIQNDCNLVLYDNNRAVWASGTNGKASGCVLKMQNDGNLVIYSGSRAIWASNTNRQNGNYYLILQRDRNVVIYDNSNNAIWATHTNVGNAEITAIPHSNGTAAASGAAQNKVNELYISMYSRSKRIAG

SEQ ID NO: 865 - protein, 44 aa, Hordeum vulgare
ATITVVNRCSYTVWPGALPGGGVRLDPGQRWALNMPAGTAGAAV

SEQ ID NO: 866 - protein, 37 aa, Hordeum vulgare
  misc_feature (35)..(36): Xaa can be any naturally occurring amino acid
ATFTVINKCQYTVWAAAVPAGGGQKLDAGQTWSIXXP

SEQ ID NO: 867 - protein, 80 aa, Arabidopsis thaliana
MAKSATIITFLFAALVLFAAFEAPTMVEAQKLCEKPSGTWSGVCGNSNACKNQCINLEGAKHGSCNYVFPAHKCICYVPC

SEQ ID NO: 868 - protein, 60 aa, Pisum sativum
ALSFLFLFLFVAQEIVVTEANTCEHLADTYRGVCFTDASCDDHCKNKAHLISGTCHNFKC

SEQ ID NO: 869 - protein, 76 aa, Macadamia integrifolia
SAFTVWSGPGCNNRAERYSKCGCSAIHQKGGYDFSYTGQTAALYNQAGCSGVAHTRFGSSARACNPFGWKSIFIQC

SEQ ID NO: 870 - protein, 64 aa, Mesembryanthemum crystallinum
MAKVSSSLLKFAIVLILVLSMSAIISAKCIKNGKGCREDQGPPFCCSGFCYRQVGWARGYCKNR

SEQ ID NO: 871 - protein, 102 aa, Macadamia integrifolia
MASTKLFFSVITVMMLIAMASEMVNGSAFTVWSGPGCNNRAERYSKCGCSAIHQKGGYDFSYTGQTAALYNQAGCSGVAHTRFGSSARACNPFGWKSIFIQC

SEQ ID NO: 872 - protein, 61 aa, Mirabilis jalapa
LPVAFLKFAIVLILFIAMSAMIEAQCIGNGGRCNENVGPPYCCSGFCLRQPGQGYGYCKNR

SEQ ID NO: 873 - protein, 30 aa, Amaranthus caudatus
VGECVRGRCPSGMCCSQFGYCGKGPKYCGR

SEQ ID NO: 874 - protein, 63 aa, Mirabilis jalapa
MAKVPIAFLKFVIVLILFIAMSGMIEACIGNGGRCNENVGPPYCCSGFCLRQPNQGYGVCRNR

SEQ ID NO: 875 - protein, 22 aa, Spinacia oleracea
  misc_feature (1)..(1): Xaa can be any naturally occurring amino acid
XTCESPSHKFKGPCATNRNCES

SEQ ID NO: 876 - protein, 52 aa, Spinacia oleracea
GIFSSRKCKTPSKTFKGICTRDSNCDTSCRYEGYPAGDCKGIRRRCMCSKPC

SEQ ID NO: 877 - protein, 25 aa, Spinacia oleracea
GIFSSRKCKTVSKTFRGICTRNANC

SEQ ID NO: 878 - protein, 23 aa, Spinacia oleracea
MFFSSKKCKTVSKTFRGPCVRNA

SEQ ID NO: 879 - protein, 24 aa, Spinacia oleracea
  misc_feature (12)..(12): Xaa can be any naturally occurring amino acid
MFFSSKKCKTVXKTFRGPCVRNAN

SEQ ID NO: 880 - protein, 24 aa, Spinacia oleracea
  misc_feature (8)..(8): Xaa can be any naturally occurring amino acid
  misc_feature (19)..(19): Xaa can be any naturally occurring amino acid
  misc_feature (22)..(23): Xaa can be any naturally occurring amino acid
GIFSNMYXRTPAGYFRGPXGYXXN

SEQ ID NO: 881 - protein, 38 aa, Spinacia oleracea
GIFSSRKCKTPSKTFKGYCTRDSNCDTSCRYEGYPAGD

SEQ ID NO: 882 - protein, 33 aa, Zea mays
RSGRGECRRQCLRRHEGQPWETQECMRRCRRRG

SEQ ID NO: 883 - protein, 120 aa, Capsella bursa-pastoris
MASKTLILLGLFAILLVVSEVSAARESGMVKPESEETVQPEGYGGHGGHGGHGGHGGHGGHGHGGGGHGLDGYHGGHGGHGGGYNGGGGHGGHGGGYNGGGHHGGGGHGLNEPVQTQPGV

SEQ ID NO: 884 - protein, 333 aa, Impatiens balsamina
MVQKGVVFGVLLILFICSTLTSADSKPNPTKEEEPAKKPDEVSVKSGGPEVSEDQYRHRCCAWGPGRKYCKRWCANAEEAAAAIPEASEELAQEEAPVYSEDQWGRRCCGWGPGRRYCVRWCQNAEEAAAAIPEATEKAQEAPVYSEDQWGRRCCGWGPGRRYCVRWCQNAEEAAAAVAIPEASEKAQEGPVYSEDQWGRRCCGWGPGRRYCVRWCSNAADEVATPEDVEPGQYGRRCCNWGPGRRYCKRWCHNAAEEATLKAFEEEAAREQPVYSEDQWGRRCCGWGPGRRYCRRWCQSAEEAAAFQAGEVTASLMLIMFKACPCMGPVPSV

SEQ ID NO: 885 - protein, 132 aa, Allium cepa
MVRVVSLLAASTFILLIMIISSPYANSQNICPRVNRIVTPCVAYGLGRAPIAPCCRALNDLRFVNTRNLRRAACRCLVGVVNRNPGLRRNPRFQNIPRDCRNTFVRPFWWRPRIQCGRINLTDKLIYLDAEE

SEQ ID NO: 886 - protein, 41 aa, Ipomoea nil
QQCGRQASGRLCGNRLCCSQWGYCGSTASYCGAGCQSQCRS

SEQ ID NO: 887 - protein, 86 aa, Amaranthus hypochondriacus
MVNMKCVALIVIVMMAFMMVDPSMGVGECVRGRCPSGMCCSQFGYCGKGPKYCGRASTTVDHQADVAATKTAKNPTDAKLAGAGSP

SEQ ID NO: 888 - protein, 37 aa, Phytolacca americana
ACIKNGGRCVASGGPPYCCSNYCLQIAGQSYGVCKKH

SEQ ID NO: 889 - protein, 26 aa, Avena sativa
TTITVVNKCSYTVWPGALPGGGVVLD

SEQ ID NO: 890 - protein, 93 aa, Zea mays
MAKFFNYTIIQGLLMLSMVLLASCAIHAHIISGETEEVSNTGSPTVMVTMGANRKIIEDNKNLLCYLRALEYCCARTRQCYDDIKKCLEHCRG

SEQ ID NO: 891 - protein, 96 aa, Zea mays
MVKILDHISIRGFFLLFMVLVASFVGHAQIIRGETKEDNDTKSMTMTTMRPGSYVTSMDEKSSLCFEDIKTLWYICRTTYHLYRTLKDCLSHCNSM

SEQ ID NO: 892 - protein, 95 aa, Zea mays
MVKSLDHITIRGLFLLFMFLVASFVGHAQIIRGETKENKDTNSMTMTTRPGSYVISMDEKSSLCFLDPRTLWYICKITYRLFRTLKDCLEFCHSI

SEQ ID NO: 893 - protein, 73 aa, Zea mays
MVLLASCVIHAHIISGEIEDVSNTRSPTMMGANRKIIGDNKNLLCYLKALEYCCERTKQCYDDIKKCLEHCHS

SEQ ID NO: 894 - protein, 16 aa, Basella alba
KIMAKPSKFYEQLRGR

SEQ ID NO: 895 - protein, 208 aa, Nicotiana tabacum
GKLSTLLLVLILYFIAAGANAQQCGRQRGGALCSGNLCCSQFGWCGSTPEYCSPSQGCQSQCSGGGGGGGGGGGGGAQNVRATYHIYNPQNVGWDLYAVSAYCSTWDGNKPLAWRRKYGWTAFCGPVGPRGRDSCGKCLRVTNTGTGAQTTVRIVDQCSNGGLDLDVNVFRQLDTDGRGNQRGHLIVNYEFVNCGDNMNVLLSPVDKE

SEQ ID NO: 896 - protein, 211 aa, Nicotiana tabacum
MGKLSTLLFALVLYVIAAGANAQQCGRQRGGALCSGNLCCIQFGWCGSTQEYCSPSQGCQSQCSGGGGGGGGGGGGGGAAQNVRATYHIYNPQNVGWDLYAVSAYCSTWDGNKPLAWRRKYGWTAFCGPVGPRGRDSCGKCLRVTNTGTGAQTTVRIVDQCSNGGLDLDVNVFRQLDTDGRGNQRGHLIVNYEFVNCGDNMNVLVSPVDKE

SEQ ID NO: 897 - protein, 378 aa, Nicotiana tabacum
MANSVTLFSIIFSCFLLRQLVCTNSQNVIKGGYWFKNSGLALNNIDSTLFTHLFCAFADLNPQSNQLIISPENQDSFSQFTSTVQRKNPSVKTFLSIAGGRADTTAYGIMARQPNSRKSFIDSSIRLARQFGFHGLDLDWEYPLSATDMTNLGILLNEWRTAINMEARNSGRAALLLTAAVSYSPRVNGLNYPVESVARNLNWINLMAYDFYGPNWSPSQTNSHAQLFDPVNHISGSDGINAWIQAGVPTKKLVLGIPFYGYAWRLVNPNIHDLRAPAAGKSNVGAVDDGSMTYNRIRDYIVQSRATTVYNATIVGDYCYSGSNWISYDDTQSVRNKVNYVKGRGLLGYFAWHVAGDQNWGLSRTASQTWGVSSQEMK

SEQ ID NO: 898 - protein, 280 aa, Zea mays
MANAPRILALGLLALLCAAAGPAAAQNCGCQPNFCCSKFGYCGTTDAYCGDGCQSGPCRSGGGGGGGGGGGGGGSGGANVANVVTDAFFNGIKNQAGSGCEGKNFYTRSAFLSAVNAYPGFAHGGTEVEGKREIAAFFAHVTHETGHFCYISEINKSNAYCDASNRQWPCAAGQKYYGRGPLQISWNYNYGPAGRDIGFNGLADPNRVAQDAVIAFKTALWFWMNNVHRVMPQGFGATIRAINGALECNGNNPAQMNARVGYYKQYCQQLRVDPGPNLIC

SEQ ID NO: 899 - protein, 268 aa, Zea mays
QLVALGLALLCAVAGPAAAQNCGCQPNVCCSKFGYCGTTDEYCGDGCQSGPCRSGRGGGGSGGGGANVASVVTSSFFNGIKNQAGSGCEGKNFYTRSAFLSAVKGYPGFAHGGSQVQGKREIAAFFAHATHETGHFCYISEINKSNAYCDPTKRQWPCAAGQKYYGRGPLQISWNYNYGPAGRAIGFDGLGDPGRVARDAVVAFKAALWFWMNSVHGVVPQGFGATTRAMQRALECGGNNPAQMNARVGYYRQYCRQLGVDPGPNLTC

SEQ ID NO: 900 - protein, 377 aa, Nicotiana tabacum [sequence omitted]

SEQ ID NO: 901 - protein, 15 aa, Hydrangea macrophylla
NSMERVEELRKKLQD

SEQ ID NO: 902 - protein, 52 aa, Hordeum vulgare
ATYHYYRPAQNNWDLGAPAVSAYCATWDASKYGWTAFIVDQCANGGLDLDWN

SEQ ID NO: 903 - protein, 30 aa, Chassalia parviflora
GIPCGESCVWIPCISAALGCSCKNKVCYRN

SEQ ID NO: 904 - protein, 31 aa, Chassalia parviflora
GVIPCGESCVFIPCISTLLGCSCKNKVCYRN

SEQ ID NO: 905 - protein, 31 aa, Psychotria longipes
SIPCGESCVFIPCTVTALLGCSCKSKVCYKN

SEQ ID NO: 906 - protein, 27 aa, Brassica rapa
QKLCERPSGTWSGVCGNNNACKNQCIN

SEQ ID NO: 907 - protein, 51 aa, Sinapis alba
QKLCERPSGTWSGVCGNNNACKNQCINLEKARHGSCNYVFPAHKCICYFPC

SEQ ID NO: 908 - protein, 80 aa, Raphanus sativus
MAKFASIIALLFAALVLFAAFEAPTMVEAQKLCERPSGTWSGVCGNNNACKNQCINLEKARHGSCNYVFPAHKCICYFPC

SEQ ID NO: 909 - protein, 80 aa, Arabidopsis thaliana
MAKSATIVTLFFAALVFFAALEAPMVVEAQKLCERPSGTWSGVCGNSNACKNQCINLEKARHGSCNYVFPAHKCICYFPC

SEQ ID NO: 910 - protein, 23 aa, Brassica napus
QKLCERPSGTWSGVCGNNNACKN

SEQ ID NO: 911 - protein, 27 aa, Brassica napus
  misc_feature (11)..(11): Xaa can be any naturally occurring amino acid
QKLCERPSGTXSGVCGNNNACKNQCIR

SEQ ID NO: 912 - protein, 80 aa, Raphanus sativus
MAKFASIIVLLFVALVVFAAFEEPTMVEAQKLCQRPSGTWSGVCGNNNACKNQCIRLEKARHGSCNYVFPAHKCICYFPC

SEQ ID NO: 913 - protein, 51 aa, Sinapis alba
QKLCQRPSGTWSGVCGNNNACRNQCINLEKARHGSCNYVFPAHKCICYFPC

SEQ ID NO: 914 - protein, 52 aa, Sinapis alba
QKLCARPSGTWSSGNCRNNNACRNFCIKLEKSRHGSCNIPFPSNKCICYFPC

SEQ ID NO: 915 - protein, 79 aa, Brassica napus
MAKFASIITLLFAALVVFAAFEAPTMVEAKLCERSSGTWSGVCGNNNACKNQCIRLEGAQHGSCNYVFPAHKCICYFPC

SEQ ID NO: 916 - protein, 79 aa, Raphanus sativus
MAKFASIVALLFAALVVFAAFEAPTVVEAKLCERSSGTWSGVCGNNNACKNQCIRLEGAQHGSCNYVFPAHKCICYFPC

SEQ ID NO: 917 - protein, 80 aa, Raphanus sativus
MAKFVSIITLLFVALVLFAAFEAPTMVEAQKLCERSSGTWSGVCGNNNACKNQCINLEGARHGSCNYIFPYHRCICYFPC

SEQ ID NO: 918 - protein, 46 aa, Pisum sativum
KTCEHLADTYRGVCFTNASCDDHCKNKAHLISGTCHNWKCFCTQNC

SEQ ID NO: 919 - protein, 47 aa, Pisum sativum
KTCENLSGTFKGPCIPDGNCNKHCRNNEHLLSGRCRDDFRCWCTNRC

SEQ ID NO: 920 - protein, 75 aa, Capsicum annuum
MAGFSKVIATIFLMMMLVFATDMMAEAKICEALSGNFKGLCLSSRDCGNVCRREGFTSGVCRGFPLKCFCRKPGA

SEQ ID NO: 921 - protein, 80 aa, Brassica rapa
MAKFVSIITLFFAALVLFAAFEAPTMVKAQKLCERSSGTWSGVCGNNNACKNQCINLEGARHGSCNYVFPYHRCICYFPC

SEQ ID NO: 922 - protein, 108 aa, Helianthus annuus
MAKISVAFNAFLLLLFVLAISEIGSVKGELCEKASQTWSGTCGKTKHCDDQCKSWEGAAHGACHVRDGKHMCFCYFNCSKAQKLAQDKLRAEELAKEKIEPEKATAKP

SEQ ID NO: 923 - protein, 41 aa, Helianthus annuus
SHRFQGTCLSDTNCANVCHSERFSGGKCRGFRRRCFCTTHC

SEQ ID NO: 924 - protein, 82 aa, Triticum aestivum
MASTRRMAAAPAVLLLLLLLVATEMGTMKTAEARTCLSQSHKFKGTCLSNSNCAAVCRTENFPDGECNTHLVERKCYCKRTC

SEQ ID NO: 925 - protein, 54 aa, Heuchera sanguinea
DGVKLCDVPSGTWSGHCGSSSKCSQQCKDREHFAYGGACHYQFPSVKCFCKRQC

SEQ ID NO: 926 - protein, 50 aa, Dahlia merckii
ELCEKASKTWSGNCGNTGHCDNQCKSWEGAAHGACHVRNGKHMCFCYFNC

SEQ ID NO: 927 - protein, 50 aa, Aesculus hippocastanum
LCNERPSQTWSGNCGNTAHCDKQCQDWEKASHGACHKRENHWKCFCYFNC

SEQ ID NO: 928 - protein, 49 aa, Clitoria ternatea
NLCERASLTWTGNCGNTGHCDTQCRNWESAKHGACHKRGNWKCFCYFNC

SEQ ID NO: 929 - protein, 20 aa, Dahlia merckii
EVCEKASKTWSGNCGNTGHC

SEQ ID NO: 930 - protein, 42 aa, Helianthus annuus
LSHSFKGTCLSDTNCANVCHSERFSGGKCRGFRRRCFCTTHC

SEQ ID NO: 931 - protein, 77 aa, Elaeis guineensis
MEHSRRMLPAILLLLFLLMPSEMGTKVAEARTCESQSHKFQGTCLRESNCANVCQTEGFQGGVCRGVRRRCFCTRLC

SEQ ID NO: 932 - protein, 75 aa, Capsicum annuum
MAGFSKVVATIFLMMLLVFATDMMAEAKICEALSGNFKGLCLSSRDCGNVCRREGFTDGSCIGFRLQCFCTKPCA

SEQ ID NO: 933 - protein, 74 aa, Capsicum annuum
MAGFSKVIATIFLMMMLVFATGMVAEARTCESQSHRFKGLCFSKSNCGSVCHTEGFNGGHCRGFRRRCFCTRHC

SEQ ID NO: 934 - protein, 80 aa, Brassica oleracea
MAKVASIVALLFPALVIFAAFEAPTMVEAQKLCERPSGTWSGVCGNNNACKNQCIRLEKARHGSCNYVFPAHKCICYFPC

SEQ ID NO: 935 - protein, 79 aa, Prunus persica
MERSMRLFSTAFVFFLLLAAAGMMMGPMVAEARTCESQSNRFKGTCVSTSNCASVCQTEGFPGGHCRGFRRRCFCTKHC

SEQ ID NO: 936 - protein, 280 aa, Zea mays
MANAPRILALGLLALLCAAAGPAAAQNCGCQPNFCCSKFGYCGTTDAYCGDGCQSGPCRSGGGGGGGGGGGGGGSGGANVANVVTDAFFNGIKNQAGSGCEGKNFYTRSAFLSAVNAYPGFAHGGTEVEGKREIAAFFAHVTHETGHFCYISEINKSNAYCDASNRQWPCAAGQKYYGRGPLQISWNYNYGPAGRDIGFNGLADPNRVAQDAVIAFKTALWFWMNNVHGVMPQGFGATIRAINGALECNGNNPAQMNARVGYYKQYCQQLRVDPGPNLIC

SEQ ID NO: 937 - protein, 269 aa, Zea mays
PQLVALGLALLCAVAGPAAAQNCGCQPNVCCSKFGYCGTTDEYCGDGCQSGPCRSGRGGGGSGGGGANVASVVTSSFFNGIKNQAGSGCEGKNFYTRSAFLSAVKGYPGFAHGGSQVQGKREIAAFFAHATHETGHFCYISEINKSNAYCDPTKRQWPCAAGQKYYGRGPLQISWNYNYGPAGRAIGFDGLGDPGRVARDAVVAFKAALWFWMNSVHGVVPQGFGATTRAMQRALECGGNNPAQMNARVGYYRQYCRQLGVDPGPNLTC

SEQ ID NO: 938 - protein, 47 aa, Vicia faba
LLGRCKVKSNRFHGPCLTDTHCSTVCRGEGYKGGDCHGLRRRCMCLC

SEQ ID NO: 939 - protein, 47 aa, Vicia faba
LLGRCKVKSNRFNGPCLTDTHCSTVCRGEGYKGGDCHGLRRRCMCLC

SEQ ID NO: 940 - protein, 103 aa, Petunia x hybrida
MARSICFFAVAILALMLFAAYDAEAATCKAECPTWDSVCINKKPCVACCKKAKFSDGHCSKILRRCLCTKECVFEKTEATQTETFTKDVNTLAEALLEADMMV

SEQ ID NO: 941 - protein, 101 aa, Petunia x hybrida
MARSICFFAVAILALMLFAAYETEAGTCKAECPTWEGICINKAPCVKCCKAQPEKFTDGHCSKILRRCLCTKPCATEEATATLANEVKTMAEALVEEDMME

SEQ ID NO: 942 - protein, 78 aa, Helianthus annuus
MKSSMKMFAALLLVVMCLLANEMGGPLVVEARTCESQSHKFKGTCLSDTNCANVCHSERFSGGKCRGFRRRCFCTTHC

SEQ ID NO: 943 - protein, 77 aa, Arabidopsis thaliana
MKLSMRLISAVLIMFMIFVATGMGPVTVEARTCESQSHRFKGTCVSASNCANVCHNEGFVGGNCRGFRRRCFCTRHC

SEQ ID NO: 944 - protein, 77 aa, Arabidopsis thaliana
MKFSMRLISAVLFLVMIFVATGMGPVTVEARTCASQSQRFKGKCVSDTNCENVCHNEGFPGGDCRGFRRRCFCTRNC

SEQ ID NO: 945 - protein, 77 aa, Arabidopsis thaliana
MKLSVRFISAALLLFMVFIATGMGPVTVEARTCESKSHRFKGPCVSTHNCANVCHNEGFGGGKCRGFRRRCYCTRHC

SEQ ID NO: 946 - protein, 73 aa, Arabidopsis thaliana
MKLSLRLISALLMSVMLLFATGMGPVEARTCESPSNKFQGVCLNSQSCAKACPSEGFSGGRCSSLRCYCSKAC

SEQ ID NO: 947 - protein, 80 aa, Eutrema wasabi
MAKFASIIALLFAALVLFSAFEAPSMVEAQKLCEKSSGTWSGVCGNNNACKNQCINLEGARHGSCNYIFPYHRCICYFPC

SEQ ID NO: 948 - protein, 105 aa, Lycopersicon esculentum
MARSIFFMAFLVLAMMLFVTYEVEAQQICKAPSQTFPGLCFMDSSCRKYCIKEKFTGGHCSKLQRKCLCTKPCVFDKISSEVKATLGEEAKTLSEVVLEEEIMME

SEQ ID NO: 949 - protein, 171 aa, Gastrodia elata
MAASASTAVILFFAVTTMMSLSAIPAFASDRLNSGHQLDTGGSLAQGGYLFIIQNDCNLVLYDNNRAVWASGTNGKASGCMLKMQNDGNLVIYSGSRAIWASNTNRQNGNYYLILQRDRNVVIYDNSNNAIWATHTNVGNAEITVIPHSNGTAAASGAAQNKVNELYISMY

SEQ ID NO: 950 - protein, 171 aa, Gastrodia elata
MAASASTAVILFFAVTTMMSLSAIPAFASDRLNSGHQLDTGGSLAQGGYLFIIQNDCNLVLYDNNRAVWASGTNGKASNCFLKMQNDGNLVIYSGSRAIWASNTNRQNGNYYLILQRDRNVVIYDNSNNAIWATHTNVGNAEITVIPHSNGTAAASGAAQNKVNELYISMY

SEQ ID NO: 951 - protein, 171 aa, Gastrodia elata
MAASASTAVILFFAVTTVMSLSAIPAFASDRLNSGHQLDTGGSLAQGGYLFIIQNDCNLVLYDNNRAVWASGTNGKASGCMLKMQNDGNLVIYSGSRAIWASNTNRQNGNYYLILQRDRNVVIYDNSNNAIWATHTNVGNAEITVIPHSNGTAAASGAAQNKVNELYISMY

SEQ ID NO: 952 - protein, 171 aa, Gastrodia elata
MAASASTAVILFFAVTTVMSLSAIPAFASDRLNSGHQLDTGGSLAQGGYLFIIQNDCNLVLYDNNRAVWASGTNGKASNCFLKMQNDGNLVIYSGSRAIWASNTNRQNGNYYLILQRDRNVVIYDNSNNAIWATHTNVGNAEITVIPHSNGTAAASGAAQNKVNELYISMY

SEQ ID NO: 953 - protein, 73 aa, Arabidopsis thaliana
MENKFFAAFFLLLVLFSSQEIIGGEGRTCQSKSHHFKYMCTSNHNCAIVCRNEGFSGGRCHGFHRRCYCTRLC

SEQ ID NO: 954 - protein, 40 aa, Ginkgo biloba
ANTAFVSSAHNTQKIPAGAPFNRNLRAMLADLRQNAAFAG

SEQ ID NO: 955 - protein, 204 aa, Hevea brasiliensis
MNIFIVVLLCLTGVAIAEQCGRQAGGKLCPNNLCCSQWGWCGSTDEYCSPDHNCQSNCKDSGEGVGGGSASNVLATYHLYNSQDHGWDLNAASAYCSTWDANKPYSWRSKYGWTAFCGPVGAHGQSSCGKCLSVTNTGTGAKTTVRIVDQCSNGGLDLDVNVFRQLDTDGKGYERGHITVNYQFVDCGDSFNPLFSVMKSSVIN

SEQ ID NO: 956 - protein, 320 aa, Euonymus europaeus
MKYLWVFIVFSIAVLSHACSAQQCGRQAGNRRCANNLCCSQYGYCGRTNEYCCTSQGCQSQCRRCGVRTVGEIVVGDIGGIISKGMFNNILKHRDDDACEGKGFYTYEAFVAAARSFPAFGSTGDDATRKREIAAFLAQTSHETSAGWPSAPDGPYAWGYCFVRERNPPSKYCDTTTPCPKSYYGRGPIQLTWNYNYEQAGRAIGADLLNNPDLVATDAVISFKTAIWFWMTAQSSKPSCHDVITGSWRPSASDNSVCHVPDYAVVTNIISGEIEYGKSRNPQVEDRIEFFKRYCQILGVSPGKCYEERTFVSGLMMETI

SEQ ID NO: 957 - protein, 305 aa, Euonymus europaeus
MKYLWVFIVFSIAVLSLACSAQQCGRQAGNRRCPNNLCCSQFGYCGRTNEYCCTGFGCQSNCRRCGVRTVGEDVVGDIGGIISKGMFNNILKHRDDDACEGKGFYTYEAFVAAARSFPAFGSTGDDTTRKREIAAFLAQTSHETSGGRPSAPDGPYAWGYCFVKERNPPSKYCDTITPCPKSYYGRGPLQLTWNYNYAQAGRAIGVDLLNNPDLVATDAVTSFKTAIWFWMTAHSSKPSCHDVITGSWRPSASDNSVRHVPDYAVVTNIINGEIEYGKSRNPQVEDRIEFFKRYCQILGVSPGKF

SEQ ID NO: 958 - protein, 137 aa, Hordeum vulgare
MAPSKSIKSVVICVLILGLVLEQVQVEGKSCCKDTLARNCYNTCHFAGGSRPVCAGACRCKIISGPKCPSDYPKLNLLPESGEPDVTQYCTIGCRNSVCDNMDNVFRGQEMKFDMGLCSNACARFCNDGAVIQSVEA

SEQ ID NO: 959 - protein, 111 aa, Gastrodia elata
QSSPGILLNQPASMASPASSAVIFFFAVAALMSLLAMPALAASQLNAGQTLGTGQSLAQGPNQFIIQNDCNLVLYASNKAVWATGTNGKASGCVLRMQRDGNLVIYSGSKV

SEQ ID NO: 960 - protein, 47 aa, Nicotiana tabacum
RECKTESNTFPGICITKPPCRKACISEKFTDGHCSKILRRCLCTKPC

SEQ ID NO: 961 - protein, 250 aa, Nicotiana tabacum
MSNNMGNLRSSFVFFLLALVTYTYAATIEVRNNCPYTVWAASTPIGGGRRLDRGQTWVINAPRGTKMARVWGRTNCNFNAAGRGTCQTGDCGGVLQCTGWGKPPNTLAEYALDQFSGLDFWDISLVDGFNIPMTFAPTNPSGGKCHAIHCTANINGECPRELRVPGGCNNPCTTFGGQQYCCTQGPCGPTFFSKFFKQRCPDAYSYPQDDPTSTFTCPGGSTNYRVIFCPNGQAHPNFPLEMPGSDEVAK

SEQ ID NO: 962 - protein, 251 aa, Nicotiana tabacum
MSHLTTFLVFFLLAFVTYTYASGVFEVHNNCPYTVWAAATPVGGGRRLERGQSWWFWAPPGTKMARIWGRTNCNFDGAGRGWCQTGDCGGVLECKGWGKPPNTLAEYALNQFSNLDFWDISVIDGFNIPMSFGPTKPGPGKCHGIQCTANINGECPGSLRVPGGCNNPCTTFGGQQYCCTQGPCGPTELSRWFKQRCPDAYSYPQDDPTSTFTCTSWTTDYKVMFCPYGSAHNETTNFPLEMPTSTHEVAK

SEQ ID NO: 963 - protein, 238 aa, Lycopersicon esculentum
FFFLLAFVTYTYAATFEVRNNCPYTVWAASTPIGGGRRLDRGQTWVINAPRGTKMARIWGRTNCNFDGDGRGSCQTGDCGGVLQCTGWGKPPNTLAEYALDQFSNLDFWDISLVDGFNIPMTFAPTNPSGGKCHAIHCTANINGECPGSLRVPGGCNNPCTTFGGQQYCCTQGPCGPTDLSRFFKQRCPDAYSYPQDDPTSTFTCPSGSTNYRVVFCPNGVTSPNFPLEMPSSDEEAK

SEQ ID NO: 964 - protein, 233 aa, Lycopersicon esculentum
AFVTYTYAATFEVRNNCPYTVWAASTPIGGGRRLDRGQTWVINAPRGTKMARIWGRTNCNFDGAGRGSCQTGDCGGVLQCTGWGKPPNTLAEYALDQFSNLDFWDISLVDGFNIPMTFAPTNPSGGKCHAIHCTANINGECPGSLRVPGGCNNPCTTFGGQQYCCTQGPCGPTDLSRFFKQRCPDAYSYPQDDPTSTFTCPSGSTNYRVVFCPNGVTSPNFPLEMPSSDEEAK

SEQ ID NO: 965 - protein, 76 aa, Arabidopsis thaliana
MKVSPRLNSALLLLFMILATVMGLVTVEARTCETSSNLFNGPCLSSSNCANVCHNEGFSDGDCRGFRRRCLCTRPC

SEQ ID NO: 966 - protein, 122 aa, Arabidopsis thaliana
MERIPSLASLVSLLIIFATVVNQTRASICNDRLGLCDGCDQRCKAKHGPSCESKCDGPVGMLLCTCTYECGPTKLCNGGLGNCGESCNEQCCDRNCAQRYNGGHGYCNTLDDFSLCLCKYPC

SEQ ID NO: 967 - protein, 81 aa, Pyrus pyrifolia
LVSTAFVLVLLLATIEMGPMGVEARTESSKAVEGKICEVPSTLFKGLCFSSNNCKHTCRKEQFTRGHCSVLTRACVCTKKC

SEQ ID NO: 968 - protein, 80 aa, Arabidopsis thaliana
MAKFCTTITLILVALVLFADFEAPTIVKAELCKRESETWSGRCVNDYQCRDHCINNDRGNDGYCAGGYPWYRSCFCFFSC

SEQ ID NO: 969 - protein, 80 aa, Arabidopsis thaliana
MAKSAAIITFLFAALVLFAAFEAPIMVEAQKLCEKPSGTWSGVCGNSNACKNQCINLEGAKHGSCNYVFPAHKCICYFPC

SEQ ID NO: 970 - protein, 80 aa, Arabidopsis thaliana
MAKFASIITFIYAALVLFAAFEVPTMVEAQKLCEKPSGTWSGVCGNSNACKNQCINLEGAKHGSCNYVFPAHKCICYVPC

SEQ ID NO: 971 - protein, 80 aa, Arabidopsis thaliana
MAKFASIITLIFAALVLFAAFDAPAMVEAQKLCEKPSGTWSGVCGNSNACKNQCINLEGAKHGSCNYVFPAHKCICYVPC

SEQ ID NO: 972 - protein, 87 aa, Pyrus pyrifolia
MEPSMRLISAAFVLILLLATTEMGPMGVEAKSKSSKEVEKRTCEAASGKFKGMCFSSNNCANTCAREKFDGGKCKGFRRRCMCTKKC

SEQ ID NO: 973 - protein, 87 aa, Pyrus pyrifolia
MERSMRLVSAAFVLVLLLAATEMGPMGVEARTESSKAVEGKICEVPSTLFKGLCFSSNNCKHTCRKEQFTRGHCSVLTRACVCTKKC

SEQ ID NO: 974 - protein, 78 aa, Capsicum annuum
MAHSMRFFAIVLLLAMLVMATEMGPMRIVEARTCESQSHRFKGVCASETNCASVCQTEGFSGGDCRGFRRRCFCTRPC

SEQ ID NO: 975 - protein, 78 aa, Arabidopsis thaliana
MASSYTLMLFLCLSIFLIASTEMMAVEGRICERRSKTWTGFCGNTRGCDSQCKRWERASHGACHAQFPGFACFCYFNC

SEQ ID NO: 976 - protein, 83 aa, Picea abies
MADKGVGSRLSALFLLVLLVISIGMMQLEPAEGRTCKTPSGKFKGVCASRNNCKNVCQTEGFPSGSCDFHVANRKCYCSKPCP

SEQ ID NO: 977 - protein, 22 aa, Sorghum bicolor
AVFTVVNRCPYTVWAASVPVGG

SEQ ID NO: 978 - protein, 41 aa, Lycopersicon esculentum
  misc_feature (17)..(17): Xaa can be any naturally occurring amino acid
  misc_feature (34)..(34): Xaa can be any naturally occurring amino acid
  misc_feature (36)..(36): Xaa can be any naturally occurring amino acid
  misc_feature (40)..(40): Xaa can be any naturally occurring amino acid
AVHNDARAQVGVGPMSXDANLASRAQNYANSRAXDXNLIXS

SEQ ID NO: 979 - protein, 35 aa, Lycopersicon esculentum
  misc_feature (2)..(2): Xaa can be any naturally occurring amino acid
  misc_feature (29)..(29): Xaa can be any naturally occurring amino acid
DXLAVHNDARAQVGAGPMDANLASRAQNXANSRAG

SEQ ID NO: 980 - protein, 97 aa, Lycopersicon esculentum
  misc_feature (20)..(20): Xaa can be any naturally occurring amino acid
  misc_feature (38)..(38): Xaa can be any naturally occurring amino acid
DYLNAHNAARRQVGVGPMTXDNRLAAFAQNYANQRADXRMQHSGGPYGENLAAAFPQLNCQAGKVCGHYTQVVWRNSVRLGCARVRCNNGWYFITCN

SEQ ID NO: 981 - protein, 23 aa, Triticum aestivum
ATITVVNRCSYTVWPGALPGGGA

SEQ ID NO: 982 - protein, 666 aa, Macadamia integrifolia
MAINTSNLCSLLFLLSLFLLSTTVSLAESEFDRQEYEECKRQCMQLETSGQMRRCVSQCDKRFEEDIDWSKYDNQDDPQTDCQQCQRRCRQQESGPRQQQYCQRRCKEICEEEEEYNRQRDPQQQYEQCQERCQRHETEPRHMQTCQQRCERRYEKEKRKQQKRYEEQQREDEEKYEERMKEEDNKRDPQQREYEDCRRRCEQQEPRQQYQCQRRCREQQRQHGRGGDLINPQRGGSGRYEEGEEKQSDNPYYFDERSLSTRFRTEEGHISVLENFYGRSKLLRALKNYRLVLLEANPNAFVLPTHLDADAILLVTGGRGALKMIHRDNRESYNLECGDVIRIPAGTTFYLINRDNNERLHIAKFLQTISTPGQYKEFFPAGGQNPEPYLSTFSKEILEAALNTQAERLRGVLGQQREGVIISASQEQIRELTRDDSESRRWHIRRGGESSRGPYNLFNKRPLYSNKYGQAYEVKPEDYRQLQDMDVSVFIANITQGSMMGPFFNTRSTKVVVVASGEADVEMACPHLSGRHGGRRGGKRHEEEEDVHYEQVKARLSKREAIVVPVGHPVVFVSSGNENLLLFAFGINAQNNHENFLAGRERNVLQQIEPQAMELAFAAPRKEVEELFNSQDESIFFPGPRQHQQQSSRSTKQQQPLVSILDFVGF

SEQ ID NO: 983 - protein, 666 aa, Macadamia integrifolia
MAINTSNLCSLLFLLSLFLLSTTVSLAESEFDRQEYEECKRQCMQLETSGQMRRCVSQCDKRFEEDIDWSKYDNQEDPQTECQQCQRRCRQQESGPRQQQYCQRRCKEICEEEEEYNRQRDPQQQYEQCQKHCQRRETEPRHMQTCQQRCERRYEKEKRKQQKRYEEQQREDEEKYEERMKEEDNKRDPQQREYEDCRRRCEQQEPRQQHQCQLRCREQQRQHGRGGDMMNPQRGGSGRYEEGEEEQSDNPYYFDERSLSTRFRTEEGHISVLENFYGRSKLLRALKNYRLVLLEANPNAFVLPTHLDADAILLVIGGRGALKMIHHDNRESYNLECGDVIRIPAGTTFYLINRDNNERLHIAKFLQTISTPGQYKEFFPAGGQNPEPYLSTFSKEILEAALNTQTEKLRGVFGQQREGVIIRASQEQIRELTRDDSESRHWHIRRGGESSRGPYNLFNKRPLYSNKYGQAYEVKPEDYRQLQDMDLSVFIANVTQGSMMGPFFNTRSTKVVVVASGEADVEMACPHLSGRHGGRGGGKRHEEEEDVHYEQVRARLSKREAIVVLAGHPVVFVSSGNENLLLFAFGINAQNNHENFLAGRERNVLQQIEPQAMELAFAAPRKEVEESFNSQDQSIFFPGPRQHQQQSPRSTKQQQPLVSILDFVGF

SEQ ID NO: 984 - protein, 625 aa, Macadamia integrifolia
QCMQLETSGQMRRCVSQCDKRFEEDIDWSKYDNQEDPQTECQQCQRRCRQQESDPRQQQYCQRRCKEICEEEEEYNRQRDPQQQYEQCQKRCQRRETEPRHMQICQQRCERRYEKEKRKQQKRYEEQQREDEEKYEERMKEGDNKRDPQQREYEDCRRHCEQQEPRLQYQCQRRCQEQQRQHGRGGDLMNPQRGGSGRYEEGEEKQSDNPYYFDERSLSTRFRTEEGHISVLENFYGRSKLLRALKNYRLVLLEANPNAFVLPTHLDADAILLVIGGRGALKMIHRDNRESYNLECGDVIRIPAGTTFYLINRDNNERLHIAKFLQTISTPGQYKEFFPAGGQNPEPYLSTFSKEILEAALNTQTERLRGVLGQQREGVIIRASQEQIRELTRDDSESRRWHIRRGGESSRGPYNLFNKRPLYSNKYGQAYEVKPEDYRQLQDMDVSVFIANITQGSMMGPFFNTRSTKVVVVASGEADVEMACPHLSGRHGGRGGGKRHEEEEEVHYEQVRARLSKREAIVVLAGHPVVFVSSGNENLLLFAFGINAQNNHENFLAGRERNVLQQIEPQAMELAFAASRKEVEELFNSQDESIFFPGPRQHQQQSPRSTKQQQPLVSILDFVGF

SEQ ID NO: 985 - protein, 146 aa, Triticum aestivum
MAARPMLVVALLCAAAAAATAQQATNVRATYHYYRPAQNNWDLGAPAVSAYCATWDASKPLSWRSKYGWTAFCGPAGAHGQASCGKCLQVTNPATGAQITARIVDQCANGGLDLDWDTVFTKIDTNGIGYQQGHLNVNYQFVDCRD

SEQ ID NO: 986 - protein, 148 aa, Triticum aestivum
MTMAARLMLVAALLCAAAAAATAQQATNVRATYHYYRPAQNNWDLGAPAVSAYCATWDASKPLSWRSKYGWTAFCGPAGAHGQAACGKCLRVTNPATGAQITARIVDQCANGGLDLDWDTVFTKIDTNGIGYQQGHLNVNYQFVDCRD

SEQ ID NO: 987 - protein, 206 aa, Zea mays
AVFTVVNQCPFTVWAASVPVGGGRQLNRGESWRITAPAGTTAARIWARTGCKFDASGRGSCRTGDCGGVLQCTGYGRAPNTLAEYALKQFNNLDFFDISLIDGFNVPMSFLPDGGSGCSRGPRCAVDVNARCPAELRQDGVCNNACPVFKKDEYCCVGSAANDCHPTNYSRYFKGQCPDAYSYPKDDATSTFTCPAGTNYKVVFCP

SEQ ID NO: 988 - protein, 227 aa, Zea mays
MAGSVAIVGIFVALLAVAGEAAVFTVVNQCPFTVWAASVPVGGGRQLNRGESWRITAPAGTTAARIWARTGCKFDASGRGSCRTGDCGGVLQCTGYGRAPNTLAEYALKQFNNLDFFDISLIDGFNVPMSFLPDGGSGCSRGPRCAVDVNARCPAELRQDGVCNNACPVFKKDEYCCVGSAANDCHPTNYSRYFKGQCPDAYSYPKDDATSTFTCPAGTNYKVVFCP

SEQ ID NO: 989 - protein, 30 aa, Human
ACYCRIPACIAGERRYGTCIYQGRLWAFCC

SEQ ID NO: 990 - protein, 29 aa, Human
CYCRIPACIAGERRYGTCIYQGRLWAFCC

SEQ ID NO: 991 - protein, 30 aa, Human; identical to SEQ ID NO: 56

SEQ ID NO: 992 - protein, 33 aa, Human
VCSCRLVFCRRTELRVGNCLIGGVSFTYCCTRV

SEQ ID NO: 993 - protein, 33 aa, Rabbit
VVCACRRALCLPRERRAGFCRIRGRIHPLCCRR

SEQ ID NO: 994 - protein, 33 aa, Rabbit
VVCACRRALCLPLERRAGFCRIRGRIHPLCCRR

SEQ ID NO: 995 - protein, 34 aa, Rabbit
GICACRRRFCPNSERFSGYCRVNGARYVRCCSRR

SEQ ID NO: 996 - protein, 34 aa, Rabbit; identical to SEQ ID NO: 331

SEQ ID NO: 997 - protein, 33 aa, Rabbit
VSCTCRRFSCGFGERASGSCTVNGVRHTLCCRR

SEQ ID NO: 998 - protein, 33 aa, Rabbit
VFCTCRGFLCGSGERASGSCTINGVRHTLCCRR

SEQ ID NO: 999 - protein, 32 aa, Rat; identical to SEQ ID NO: 447

SEQ ID NO: 1000 - protein, 30 aa, Rat
CSCRYSSCRFGERLLSGACRLNGRIYRLCC

SEQ ID NO: 1001 - protein, 31 aa, Rat
ACTCRIGACVSGERLTGACGLNGRIYRLCCR

SEQ ID NO: 1002 - protein, 31 aa, Guinea pig
RRCICTTRTCRFPYRRLGTCIFQNRVYTFCC

What is claimed is:

1. A method of treating an injury to a nervous system of an animal, the method comprising:
applying to the injury an effective amount of an antimicrobial peptide, BDNF, IGF-1, and Substance P, wherein the antimicrobial peptide is BNP-1 and wherein the injury comprises an acute spinal cord injury.

2. The method of claim 1, wherein a viscous substance is applied with the BNP-1, BDNF, IGF-1, and Substance P.

3. The method of claim 2, wherein the viscous substance comprises a polysaccharide.

4. The method of claim 2, wherein the viscous substance comprises hyaluronic acid.

5. The method of claim 1, wherein the BNP-1, BDNF, IGF-1, and Substance P are delivered in a slow release formula.

6. The method of claim 5, wherein the slow release formula is a matrix.

7. The method of claim 6, wherein the matrix includes a viscous substance.

8. The method of claim 6, wherein the matrix is a hydrogel.

9. The method of claim 8, wherein the hydrogel is a polymer matrix modified to contain a bifunctional poly(alkylene glycol) molecule covalently bonded to the polymer matrix.

10. The method of claim 8, wherein the hydrogel is cross-linked.

11. The method of claim 10, wherein the hydrogel is cross-linked with glutaraldehyde.

12. The method of claim 10, wherein the hydrogel is cross-linked via an interpenetrating network of one or more photopolymerizable acrylates.

13. The method of claim 8, wherein the BNP-1, BDNF, IGF-1, and Substance P are incorporated into the hydrogel.

14. The method of claim 13, wherein the BNP-1, BDNF, IGF-1, and Substance P are incorporated into the hydrogel through covalent bonds to poly(alkylene glycol) molecules of the hydrogel.

15. The method of claim 13, wherein the BNP-1, BDNF, IGF-1, and Substance P are incorporated into the hydrogel through entertainment within the hydrogel.

16. The method of claim 6, wherein the matrix is a collagen gel matrix.

17. The method of claim 16, wherein the collagen gel matrix is impregnated with the BNP-1, BDNF, IGF-1, and Substance P.

18. The method of claim 1, wherein the BNP-1, BDNF, IGF-1, and Substance P are applied with a medium with spaced supports.

19. The method of claim 18, wherein the spaced supports are selected from the group consisting of sponges, gels, and biopolymers.

* * * * *

UNITED STATES PATENT AND TRADEMARK OFFICE
CERTIFICATE OF CORRECTION

PATENT NO. : 7,862,826 B2  Page 1 of 1
APPLICATION NO. : 12/123366
DATED : January 4, 2011
INVENTOR(S) : Christopher J. Murphy et al.

It is certified that error appears in the above-identified patent and that said Letters Patent is hereby corrected as shown below:

The columns and line numbers where the errors occur in the issued patent are as follows:

Column 1, lines 16-20 replace "This invention was made with United States government support awarded by the National Institutes of Health, Grant # HL069064. The United States has certain rights in this invention." with
--This invention was made with government support under HL069064 awarded by the National Institutes of Health. The government has certain rights in the invention.--

Signed and Sealed this
Fifteenth Day of February, 2011

David J. Kappos
*Director of the United States Patent and Trademark Office*